US008912317B2

(12) United States Patent
Huynh et al.

(10) Patent No.: US 8,912,317 B2
(45) Date of Patent: Dec. 16, 2014

(54) **RIBONUCLEIC ACID INTERFERENCE MOLECULES OF *ARABIDOPSIS THALIANA***

(75) Inventors: Tien Huynh, Yorktown Heights, NY (US); Isidore Rigoutsos, Astoria, NY (US)

(73) Assignee: International Business Machines Corporation, Armonk, NY (US)

( * ) Notice: Subject to any disclaimer, the term of this patent is extended or adjusted under 35 U.S.C. 154(b) by 1110 days.

(21) Appl. No.: 12/183,166

(22) Filed: Jul. 31, 2008

(65) Prior Publication Data

US 2008/0311661 A1    Dec. 18, 2008

Related U.S. Application Data

(63) Continuation-in-part of application No. 11/351,951, filed on Feb. 10, 2006.

(60) Provisional application No. 60/652,499, filed on Feb. 11, 2005.

(51) Int. Cl.
*C07H 21/00* (2006.01)
*C12P 19/34* (2006.01)
*G01N 33/48* (2006.01)
*C07H 21/02* (2006.01)
*C07H 21/04* (2006.01)

(52) U.S. Cl.
USPC .......... 536/25.3; 435/91.1; 436/94; 536/23.1; 536/24.5

(58) Field of Classification Search
None
See application file for complete search history.

(56) References Cited

U.S. PATENT DOCUMENTS 6,108,666 A    8/2000  Floratos et al.
2008/0113342 A1 *  5/2008  Cao et al. ................... 435/6

OTHER PUBLICATIONS

Scherer et al., Approaches for the sequence-specific knockdown of mRNA, 2003, Nat. Biotechnol., 21(12), pp. 1457-1465.*
Mahato et al., Modulation of gene expression by antisense and antigene oligodeoxynucleotides and small interfering RNA, Jan. 2005, Expert Opinion on Drug Delivery, vol. 2, No. 1, pp. 3-28.*
Zhang et al., Targeted Gene Silencing by Small Interfering RNA-Based Knock-Down Technology, 2004, Current Pharmaceutical Biotechnology, vol. 5, p. 1-7.*
Altschul et al., Basic Local Alignment Search Tool, J Mol Biol., vol. 215, pp. 403-410, 1990.
Chenna et al., Multiple Sequence Alignment with the Clustal Series of Programs, Necleic Acids Research, vol. 31, No. 13, pp. 3497-3500, 2003.
Jiang et al., Pack-Mule Transposable Elements Mediate Gene Evolution in Plants, Nature Publishing Group, vol. 431, 569-573, Sep. 2004.

Lim et al., Vertebrate MicroRNA Genes, Science Magazine, vol. 299, p. 1540, Mar. 2003.
Wooton et al., Statistics of Local Complexity in Amino Acid Sequences and Sequence Databases, Computer and Chemistry, vol. 17, No. 2, pp. 149-163, 1993.
Matthews et al., Expanded Sequence Dependence of Thermodynamic Parameters Improves Prediction of RNA Secondary Structure, J. Mol. Biol., vol. 288, pp. 911-940, 1999.
Ashburner et al., Gene Ontology: Tool for the Unification of Biology, The Gene Ontology Consortium, Nature Genetics, vol. 25, pp. 25-29, May 2000.
Griffiths-Jones et al., Rfam: An RNA Family Database, Nucleic Acids Research, vol. 31, No. 1, pp. 439-441, 2003.
Jorgensen, Restructuring the Genome in Response to Adaptive Challenge: McClintock's Bold Conjecture Revisited, Cold Spring harbor Symposia on Quantitative Biology, vol. LXIX, pp. 349-354, 2004.
Lim et al., The MicroRNAs of *Caenorhabditis elegans*, Genes and Development, vol. 17, pp. 991-1008, 2003.
Xie et al., Systematic Discovery of Regulatory Motifs in Human Promotes and 3' UTRs by Comparison of Several Mammals, Nature Publishing Group, vol. 434, pp. 338-345, Mar. 2005.
Rehmsmeier et al., Fast and Effective Prediction of MicroRNA/Target Duplexes, RNA, vol. 10, pp. 1507-1517, 2004.
Bejerano et al., Ultraconserved Elements in the Human Genome, Science Magazine, vol. 304, pp. 1321-1325, May 2004.
Hofacker et al., Fast Folding and Comparison of RNA Secondary Structures, Monatshefte fur Chemie (Chemical Monthly), vol. 125, pp. 167-188, 1994.
Lai et al., Computational Identification of Drosophila MicroRNA Genes, Genome Biology, vol. 4, Issue 7, Article R42, pp. 1-20, 2003.
Rigoutsos et al., Combinatorial Pattern Discovery in Biological Sequences: The TEIRESIAS Algorithm, Bioinformatics, vol. 14, No. 1, pp. 55-67, 1998.
Berezikov et al., Phylogenetic Shadowing and Computational Identification of Human MicroRNA Genes, Cell, vol. 120, pp. 21-24, 2005.
Stark et al., Identification of *Drosophila* MicroRNA Targets, PLoS Biology, vol. 1, Issue 3, pp. 397-409, 2003.
Bentwich et al., Identification of Hundreds of Conserved and Nonconserved Human microRNAs, Nature Genetics, vol. 37, No. 7, pp. 766-770, Jul. 2005.
Iwashita et al., A Transposable Element-Mediated Gene Divergence that Directly Produced a Novel Type Bovine Bent Protein Including the Endonuclease Domain of RTE-1, Mol Biol Evol. vol. 20, No. 9, pp. 1556-1563, 2003.

(Continued)

*Primary Examiner* — Amy Bowman
(74) *Attorney, Agent, or Firm* — Ryan, Mason & Lewis, LLP

(57) ABSTRACT

Sequences of ribonucleic acid interference molecules are provided. For example, in one aspect, at least one nucleic acid molecule comprising at least one of one or more precursor sequences having SEQ_ID NO: 1 through SEQ_ID NO: 3,197 and one or more corresponding mature sequences having SEQ_ID NO: 3,198 through SEQ_ID NO: 6,565 is provided. Techniques are also provided for regulating gene expression.

5 Claims, No Drawings

(56) References Cited

OTHER PUBLICATIONS

Lev-Maor et al., The Birth of an Alternatively Spliced Exon: 3' Splice-Site Selection in Alu Exons, Science Magazine, vol. 300, pp. 1288-1291, May 2003.

Stabenau et al., The Ensemble Core Software Libraries, Genome Research, vol. 14, pp. 929-933, 2004.

Enright et al., MicroRNA Targets in *Drosophila*, Genome Biology, vol. 5, Issue 1, Article R1, pp. 1-14, 2003.

U.S. Appl. No. 11/352,152, filed Feb. 10, 2006 titled Ribonucleic Acid Interference Molecules.

U.S. Appl. No. 11/351,821, filed Feb. 10, 2006 titled System and Method for Identification of MicroRNA Target Sites and Corresponding Targeting MicroRNA Sequences.

U.S. Appl. No. 11/351,951, filed Feb. 10, 2006 titled System and Method for Identification of MicroRNA Precursor Sequences and Corresponding Mature MicroRNA Sequences from Genomic Sequences.

U.S. Appl. No. 11/367,512, filed Feb. 10, 2006 titled Techniques for Linking Non-Coding and Gene-Coding Deoxyribonucleic Acid Sequences and Applications Thereof.

U.S. Appl. No. 11/217,784, filed Aug. 31, 2005 titled Methods and Apparatus for Incremental Approximate Nearest Neighbor Searching.

U.S. Appl. No. 12/183,204, filed Jul. 31, 2008 titled Ribonucleic Acid Interference Molecules of *Oryza sativa*.

\* cited by examiner

RIBONUCLEIC ACID INTERFERENCE MOLECULES OF *ARABIDOPSIS THALIANA*

CROSS-REFERENCE TO RELATED APPLICATIONS

The present application is a continuation-in-part of, and claims priority to, U.S. patent application entitled "System and Method for Identification of MicroRNA Precursor Sequences and Corresponding Mature MicroRNA Sequences from Genomic Sequences," identified by Ser. No. 11/351,951, filed on Feb. 10, 2006, which claims the benefit of U.S. Provisional Application No. 60/652,499, filed Feb. 11, 2005, the disclosures of which are incorporated by reference herein in their entirety.

The present application is related to U.S. patent application entitled "Ribonucleic Acid Interference Molecules," identified by Ser. No. 11/352,152, and filed on Feb. 10, 2006, the disclosure of which is incorporated by reference herein in its entirety. Also, the present application is related to U.S. patent application entitled "System and Method for Identification of MicroRNA Target Sites and Corresponding Targeting MicroRNA Sequences," identified by Ser. No. 11/351,821, and filed on Feb. 10, 2006, the disclosure of which is incorporated by reference herein in its entirety.

Additionally, the present application is related to U.S. patent application entitled "Ribonucleic Acid Interference Molecules and Binding Sites Derived by Analyzing Intergenic and Intronic Regions of Genomes," identified by Ser. No. 11/408,557, and filed on Apr. 21, 2006, the disclosure of which is incorporated by reference herein in its entirety.

The present application is also related to U.S. patent application entitled "Ribonucleic Acid Interference Molecules of *Oryza Sativa*," identified by application Ser. No. 12/183,204, and filed concurrently herewith.

FIELD OF THE INVENTION

The present invention relates to genes and, more particularly, to ribonucleic acid interference molecules and their role in the regulation of gene expression.

LENGTHY TABLE

The present application includes a lengthy table section filed electronically via EFS-Web that includes the following tables: "1500-770_*Arabidopsis*_Precursor_Table," created on Jul. 31, 2008 and having a size of 556 kilobytes (KB), and "1500-770_*Arabidopsis*_Mature_Table," created on Jul. 31, 2008 and having a size of 367 KB, the contents of which are incorporated by reference herein.

A copy of the table section is available in electronic form from the USPTO web site (http://seqdata.uspto.gov/). An electronic copy of the table will also be available from the USPTO upon request and payment of the fee set forth in 37 CFR 1.19(b)(3).

BACKGROUND OF THE INVENTION

The ability of an organism to regulate the expression of its genes is of central importance. A breakdown in this homeostasis leads to disease states such as, for example, cancer, where a cell multiplies uncontrollably to the detriment of the organism. The general mechanisms utilized by organisms to maintain this gene expression homeostasis are the focus of intense scientific study.

Some cells are able to down-regulate their gene expression through certain ribonucleic acid (RNA) molecules. Namely, RNA molecules can act as potent gene expression regulators either by inducing messenger RNA (mRNA) degradation or by inhibiting translation. This activity is summarily referred to as post-transcriptional gene silencing (PTGS). An alternative name by which it is also known is RNA interference (RNAi). PTGS/RNAi has been found to function as a mediator of resistance to endogenous and exogenous pathogenic nucleic acid sequences, as well as a regulator of the expression of genes inside cells.

Early studies suggested only a limited role for RNAi, that of a defense mechanism against pathogens. However, the subsequent discovery of many endogenously-encoded microRNAs pointed towards the possibility of this being a more general, in nature, control mechanism. Recent evidence has led to conjecture that a wider spectrum of biological processes is affected by RNAi, thus extending the range of this presumed control layer.

A better understanding of the mechanism of the RNA interference process would benefit drug design, the fight against disease and the understanding of host defense mechanisms, among other things.

SUMMARY OF THE INVENTION

Sequences of ribonucleic acid interference molecules are provided. For example, in one aspect of the invention, at least one nucleic acid molecule including at least one of one or more precursor sequences having SEQ_ID NO: 1 through SEQ_ID NO: 3,197 and one or more corresponding mature sequences having SEQ_ID NO: 3,198 through SEQ_ID NO: 6,565 is provided.

In another aspect of the invention, a method for regulating gene expression comprises the following step. At least one nucleic acid molecule including at least one of one or more precursor sequences having SEQ_ID NO: 1 through SEQ_ID NO: 3,197 and one or more corresponding mature sequences having SEQ_ID NO: 3,198 through SEQ_ID NO: 6,565 is used to regulate the expression of one or more genes.

Also, in another aspect of the invention, a vector incorporating one or more sequences, wherein the one or more sequences comprise at least one of one or more precursor sequences having SEQ_ID NO: 1 through SEQ_ID NO: 3,197 and one or more corresponding mature sequences having SEQ_ID NO: 3,198 through SEQ_ID NO: 6,565 is pro-

LENGTHY TABLES

The patent contains a lengthy table section. A copy of the table is available in electronic form from the USPTO web site (http://seqdata.uspto.gov/?pageRequest=docDetail&DocID=US08912317B2). An electronic copy of the table will also be available from the USPTO upon request and payment of the fee set forth in 37 CFR 1.19(b)(3).

vided. Further, in yet another aspect of the invention, a biochemical construct comprising a nucleic acid molecule, wherein the nucleic acid molecule comprises at least one of one or more precursor sequences having SEQ_ID NO: 1 through SEQ_ID NO: 3,197 and one or more corresponding mature sequences having SEQ_ID NO: 3,198 through SEQ_ID NO: 6,565 is provided.

A more complete understanding of the present invention, as well as further features and advantages of the present invention, will be obtained by reference to the following detailed description.

DETAILED DESCRIPTION OF PREFERRED EMBODIMENTS

Principles of the present invention include ribonucleic acid (RNA) molecules and their role in gene expression regulation. The term "gene expression," as used herein, refers generally to the transcription of messenger RNA (mRNA) from a gene and its subsequent translation into a functional protein. One class of RNA molecules involved in gene expression regulation includes microRNAs, which are endogenously encoded and regulate gene expression by either disrupting the translation process or by degrading an mRNA transcript (thus, inducing post-transcriptional silencing of one or more target sequences).

MicroRNAs are transcribed as parts of longer primary transcripts known as pri-microRNAs. Pri-microRNAs are subsequently cleaved by Drosha, a double-stranded-RNA-specific ribonuclease, to form microRNA precursors or pre-microRNAs, but exceptions have also been reported (for example, mirtrons). Pre-microRNAs are exported by Exportin-5 from the nucleus into the cytoplasm where they are processed by Dicer. Dicer is a member of the RNase III family of nucleases that cleaves the pre-microRNA and forms a double-stranded RNA with 3' end overhangs that are typically two nucleotides long.

The mature microRNA is derived from either the leading or the lagging arm of the microRNA precursor. The double-stranded RNA species gets separated into its component single strands and the one corresponding to the mature microRNA becomes associated with the effector complex known as RNA-induced silencing complex (RISC). The RISC and attached microRNA base pairs with its target(s) in a sequence-directed manner using Watson-Crick pairing (and the occasional formation of G:U pairs).

As described herein, the target sequence(s) may be naturally occurring. Alternatively, the target sequences may be synthetically constructed. A target sequence may be synthetically constructed so as to, for example, test prediction methods and/or to induce the RNAi/PTGS control of genes of interest. Additionally, a target sequence may be synthetically constructed so as to control multiple genes with a single RNA molecule, as well as to modify, in a combinatorial manner, the kinetics of the reaction by, for example, introducing multiple target sites.

Similarly, the precursor sequence(s) may be either naturally occurring or synthetically constructed. For example, a precursor sequence of interest may be purified and synthetically constructed and introduced into a cell that lacks that particular precursor. Further, when any of the above sequences are naturally occurring, they may be synthetically isolated and purified, for analysis purposes, from the genome that contains them (for example, using standard molecular techniques).

The related U.S. patent applications identified above (that is, Ser. Nos. 11/352,152, 11/351,821, 11/351,951 and 11/408,557, the disclosures of which are incorporated by reference herein in their entirety) addressed several important questions. For example, given a nucleotide sequence, is the sequence part of or does it contain a microRNA precursor? Also, given the sequence of a microRNA precursor, what is the location of the segment which will give rise to the mature microRNA? Further, is there more than one mature microRNA produced by a particular precursor? And if so, what are the locations of the segments which, after transcription and processing, will give rise to these additional mature microRNAs?

Another question of interest is the following. Given the 3' untranslated region (3'UTR) of a gene of interest, which region(s) of it will function as a target(s) for some mature microRNA? This last question can also be asked when presented with the 5' untranslated region (5UTR) or the amino acid coding region of a gene of interest, or any other transcribed sequence for that matter. Also, for a given putative target site, which among a set of candidate microRNAs, if any, will bind to the putative target site?

As described herein, U.S. patent application entitled "System and Method for Identification of MicroRNA Precursor Sequences and Corresponding Mature MicroRNA Sequences from Genomic Sequences," identified by Ser. No. 11/351,951 (the disclosure of which is incorporated by reference herein in its entirety) focuses on the problem of whether a specific nucleotide sequence corresponds to a microRNA precursor or to a mature microRNA.

The above-noted techniques include a first phase during which patterns are generated by processing an appropriate training set using a pattern discovery algorithm. If the training set includes sequences of microRNA precursors, then the generated patterns, after appropriate attribute-based filtering, will be microRNA-precursor-specific. If the training set includes sequences of mature microRNAs, then the generated patterns, after appropriate attribute-based filtering, will be mature-microRNA-specific. Alternatively, the training set can include putative mature microRNAs or putative microRNA precursors. In a preferred embodiment, two training sets are used, one including sequences of known microRNA precursors and one including sequences of known mature microRNAs.

The basic idea of this pattern-based technique is to replace the training set of sequences with an "equivalent" representation that includes patterns. The patterns can be derived using, for example, a pattern discovery algorithm, such as the Teiresias algorithm. See, for example, U.S. Pat. No. 6,108,666 issued to A. Floratos and I. Rigoutsos, entitled "Method and Apparatus for Pattern Discovery in 1-Dimensional Event Streams," the disclosure of which is incorporated by reference herein. The patterns are, preferably, maximal in composition and length (properties which are, by default, guaranteed by the Teiresias algorithm).

The generated microRNA-precursor-specific or mature-microRNA-specific patterns can be used as predicates to identify, in a de novo manner, microRNA precursors from a genomic sequence, or mature microRNAs in the sequence of a putative microRNA precursor. This is exploited in the technique's second phase, during which the patterns at hand are sought in the sequence under consideration. To determine whether a given nucleotide sequence S is part of, or encodes, a microRNA precursor, the microRNA-precursor-specific patterns are used. Also, to determine whether a given nucleotide sequence S corresponds to, or contains a mature microRNA, mature-microRNA-specific patterns are used.

In general, one anticipates numerous instances of microRNA-precursor-specific patterns in sequences that correspond to microRNA precursors whereas background and unrelated sequences should receive few or no such hits. If the number of pattern instances exceeds a predetermined threshold, then the corresponding segment of the sequence that receives the pattern support (and possibly an appropriately sized flanking region) is reported as a putative microRNA precursor. Analogous comments can be made about mature-microRNA-specific patterns and sequences containing mature microRNAs.

In one or more embodiments of the present invention, pattern-discovery techniques, such as those described above, are used in conjunction with publicly available genomic sequences to predict microRNA precursor and mature microRNA sequences related to the organism *Arabidopsis thaliana* (*A. thaliana*) (the sequences were downloaded from the TAIR repository). Namely, predicted precursor sequences having SEQ_ID NO: 1 through SEQ_ID NO: 3,197 derived from the genome of *A. thaliana* are presented. Also, predicted mature sequences having SEQ_ID NO: 3,198 through SEQ_ID NO: 6,565 derived from the corresponding predicted precursors of *A. thaliana* are presented.

The aforementioned predicted precursor and mature sequences are submitted herewith in electronic text format via EFS-Web as the file "1500-770_SequenceProject_ST25_7-28-08," created on Jul. 28, 2008, having a size of 1.29 MB, the contents of which are incorporated by reference herein.

The sequences presented herein, whether precursors or matures, are DNA sequences. It should be appreciated, however, that one of ordinary skill in the art would easily be able to derive the RNA transcripts corresponding to these DNA sequences. As such, the RNA forms of these DNA sequences are considered to be within the scope of the present teachings. The global coordinates of the sequences described herein may change from one release of the genomic assembly to the next. Nonetheless, even though its location may change, the actual sequence that corresponds to a microRNA precursor and the corresponding mature microRNA are expected to remain unique and thus the corresponding sequence's new location will still be identifiable (except, of course, for the case where the sequence at hand corresponds to a segment that has been removed from the genomic assembly that is being examined).

One of ordinary skill in the art would also recognize that sequences that are either homologous or orthologous to the sequences presented herein, (for example, sequences that are related by vertical descent from a common ancestor or through other techniques (for example, through horizontal gene transfer)), will likely be present in genomes other than the ones mentioned herein. Such homologous and/or orthologous sequences are expected to generally differ from the sequences listed herein by only a small number of locations. Thus, the techniques described herein should be construed as being broadly applicable to such homologous and/or orthologous sequences from species other from those listed above.

According to an exemplary embodiment of the present invention, nucleic acid molecules may be generated based on the predicted precursor and mature sequences. The nucleic acid molecules generated may be used to regulate gene expression. As described generally above, mechanisms exist by which RNA molecules effect the expression of genes. By way of example only, the generated nucleic acid molecules may regulate the expression of a gene, or genes, by inducing post-transcriptional silencing of the gene (for example, as described above). Using the predicted precursor and mature sequences, study of gene expression may be conducted using techniques and procedures commonly known to those skilled in the art.

Assume, for example, that one is interested in modulating the expression of a given gene G. One can use a methodology such as the one described in U.S. patent application Ser. No. 11/351,821, filed on Feb. 10, 2006 and entitled "System and Method for Identification of MicroRNA Target Sites and Corresponding MicroRNA Sequences" to analyze the transcript of gene G and identify those of the mature sequences listed in the description herein that are predicted to target gene G as well as the locations along the transcript where such targeting occurs. This will provide a list L of microRNAs that are predicted to target gene G in a natural setting. One can also separately examine each microRNA, m, from the list, L, in turn, and determine the impact that expression of m can have on gene G. Additionally, one can also use information from microRNA profiling studies (for example, over time and/or across tissues) that show the level of expression of each of the microRNAs in L to determine the level of expression of G at a given time and/or in a given tissue. By employing a properly chosen subset from among the microRNAs in L, one can achieve a desired level of modulation of gene G at a given time point or given tissue.

As described herein, one or more embodiments of the present invention include the sequence of one or more nucleic acid molecules (for example, one or more isolated and purified nucleic acid molecules) of interest, wherein the sequence of the one or more nucleic acid molecules of interest include at least one of one or more precursor sequences having SEQ_ID NO: 1 through SEQ_ID NO: 3,197 and one or more corresponding mature sequences (that is, corresponding to the one or more precursor sequences) having SEQ_ID NO: 3,198 through SEQ_ID NO: 6,565. One or more of the at least one of one or more precursor sequences and one or more mature sequences may be computationally predicted. The precursor sequences and mature sequences can be, for example, computationally predicted (for example, from publicly available genomes) using a pattern discovery method. Also, the at least one nucleic acid molecule can regulate the expression of a gene by inducing post-transcriptional silencing of that gene. The nucleic acid molecule can also, for example, encode ribonucleic acid sequences as well as encode interfering ribonucleic acid sequences.

The precursor sequences having SEQ_ID NO: 1 through SEQ_ID NO: 3,197 can be derived from a genomic sequence corresponding to *A. thaliana*, and the mature sequences having SEQ_ID NO: 3,198 through SEQ_ID NO: 6,565 can be derived from a genomic sequence corresponding to *A. thaliana*.

One or more embodiments of the present invention also include techniques for regulating gene expression by using at least one nucleic acid molecule (for example, at least one isolated and purified nucleic acid molecule) including at least one of one or more precursor sequences having SEQ_ID NO: 1 through SEQ_ID NO: 3,197 and one or more corresponding mature sequences having SEQ_ID NO: 3,198 through SEQ_ID NO: 6,565 to regulate the expression of a gene.

One or more of the precursor and/or mature microRNA sequences can be, for example, synthetically removed from a genome that contains the one or more of the sequences naturally and/or the sequences can be synthetically constructed. Also, the sequences can be, for example, synthetically introduced in a genome that does not contain them naturally. In one or more embodiments of the invention, the sequences can also be transcribed at will, giving rise to one or more interfering ribonucleic acid molecules that induce post-transcriptional repression of one or more target sequences.

The above-noted techniques for regulating gene expression may also include, for example, introducing instances of the precursor microRNA of interest into an environment (for example, a cellular environment) where the nucleic acid molecule can be produced biochemically, giving rise to one or more interfering ribonucleic acid molecules that correspond to the mature microRNAs embedded in this precursor and affect one or more target sequences.

One or more embodiments of the present invention can also include a vector incorporating a sequence of one or more precursor microRNAs of interest, wherein the one or more sequences of interest include one of one or more precursor sequences having SEQ_ID NO: 1 through SEQ_ID NO: 3,197.

Additionally, one or more embodiments of the present invention can also include a biochemical construct comprising a nucleic acid molecule of interest, wherein the sequence of the nucleic acid molecule of interest includes at least one of one or more precursor sequences having SEQ_ID NO: 1 through SEQ_ID NO: 3,197 and one or more corresponding mature sequences having SEQ_ID NO: 3,198 through SEQ_ID NO: 6,565.

Although illustrative embodiments of the present invention have been described herein, it is to be understood that the invention is not limited to those precise embodiments, and that various other changes and modifications may be made by one skilled in the art without departing from the scope or spirit of the invention. For example, one may modify one or more of the described precursor sequences by adding or removing a number of nucleotides that is small enough to not radically alter the original sequence's behavior. Also, one may insert one or more of the described mature microRNA sequences in an appropriately constructed "container sequence" (for example, a precursor-like construct that is different than the precursor where this mature sequence naturally occurs) that still permits the excision of effectively the same mature microRNA sequence, thus generating an active molecule whose action is essentially unchanged with respect to that of the molecule corresponding to the starting mature microRNA sequence.

What is claimed is:

1. A method for synthetically constructing a nucleic acid molecule from sequences related to *Arabidopsis Thaliana*, the method comprising:

predicting a microRNA precursor sequence related to *Arabidopsis Thaliana*, wherein predicting a precursor sequence comprises:

generating one or more patterns of conserved sequences by processing a collection of known microRNA precursor sequences related to *Arabidopsis Thaliana* and applying a pattern discovery method to the collection of known microRNA precursor sequences to generate the one or more patterns;

assigning one or more attributes to the one or more generated patterns;

subselecting one or more candidate regions of a sample nucleotide sequence from at least one of an intergenic region and an intronic region in connection with using the one or more patterns whose one or more attributes satisfy at least one criterion; and using the one or more subselected candidate regions to predict one or more microRNA precursors in a nucleotide sequence related to *Arabidopsis Thaliana* via filtering the one or more subselected candidate regions based on, for each pattern of sequences, structure energy and number of bulges;

predicting a mature microRNA sequence related to *Arabidopsis Thaliana*, wherein predicting a precursor sequence comprises:

generating one or more patterns of conserved sequences by processing a collection of known mature microRNA sequences related to *Arabidopsis Thaliana* and applying a pattern discovery method to the collection of known mature microRNA sequences to generate the one or more patterns;

assigning one or more attributes to the one or more generated patterns;

subselecting one or more candidate regions of a sample nucleotide sequence from at least one of an intergenic region and an intronic region in connection using the one or more patterns whose one or more attributes satisfy at least one criterion;

using the one or more subselected candidate regions to predict one or more mature microRNA in a nucleotide sequence related to *Arabidopsis Thaliana* via filtering the one or more subselected candidate regions based on, for each pattern of sequences, structure energy and number of bulges; and synthetically constructing a nucleic acid molecule based on a predicted microRNA precursor sequence and a predicted mature microRNA sequence.

SEQUENCE LISTING (6565 sequences)

SEQ ID NO: 1 - DNA, 98 bp, Arabidopsis thaliana
tcaaaatgcccctgacgaaactgaacccggtttgtacgtacggaccgcgtcgttggaatccaagagaaccggatttgtacgtacactgttcatcgacg

SEQ ID NO: 2 - DNA, 138 bp, Arabidopsis thaliana
aaggtggaaatgcattacagggtaagatctctattggcaggaaaccattacttagatctttgcatctctttatgcattgcttttaattagtgagttatctgccaaaggagatttgccctgtaattcttctgcaccaac

SEQ ID NO: 3 - DNA, 112 bp, Arabidopsis thaliana
cagacccaacatggaagtgatgatggctacgactttgattttgatgctgatgtggaaatggaacagatcggtctactcgagttgagaagagtggattcccagtggatgatgt

SEQ ID NO: 4 - DNA, 106 bp, Arabidopsis thaliana
tgccatattttctgatcctaattcttcttcagttttgtggattttgattcaaagttttgatttttgaaagggagggatgaggatataattccatacgtctgcaaat

SEQ ID NO: 5 - DNA, 92 bp, Arabidopsis thaliana
taataatgctatgagatatatgaggaatggattcatatatagtctctgaactctgatacctctttctctcatgttcctgtctcctctgcatc

SEQ ID NO: 6 - DNA, 121 bp, Arabidopsis thaliana
ggattttgagattttgattgaattggcctgtagcttaatgtgattaggactctctatctttctcctttatatgaatgtggttgattcattcttcagttcatcggttgcttgctagatttag

SEQ ID NO: 7 - DNA, 65 bp, Arabidopsis thaliana
cagttgcagcagcagcaccagcggctgcaccggtgcagcaaccggctgctgctgttgctcctcaa

SEQ ID NO: 8 - DNA, 94 bp, Arabidopsis thaliana
ctcttgtcagttcatgatcagatcgtgtagcttcattaatgtgacaaaacatgtctgcatctgcatgataggataggatcataagtgactcatg

SEQ ID NO: 9 - DNA, 120 bp, Arabidopsis thaliana
ttgatcgtctctatgttttctcataatgtttttgtaaagttgtgcattggggagatttcatatgaatgtgtgtgttttgtaggatgctgcggctgatgaagaagatgatgatgatgttga

SEQ ID NO: 10 - DNA, 66 bp, Arabidopsis thaliana
tgctgttgagagagctgctgctgctgctgttgagagagctgttgctgctgctgttgggagagctgt

SEQ ID NO: 11 - DNA, 67 bp, Arabidopsis thaliana
tgttgctgctgctgctgctgctgagagagttgttgctgctgctgagagagttgctgctgcagcatct

SEQ ID NO: 12 - DNA, 83 bp, Arabidopsis thaliana
atatatatctctctgtctttgttgactttttcaggaaatattattttaaaagggtttatcaacgacagaggattaacaattat

SEQ ID NO: 13 - DNA, 90 bp, Arabidopsis thaliana
agttggaaaacgtagatgatgatgatgataaccagattgctccatacagaccggagcttcatgatcatcagcaccaaccagatgatttct

SEQ ID NO: 14 - DNA, 93 bp, Arabidopsis thaliana
aagcttctcctgattctatcttgatcattgtttctaatcatatcgatgttttgacttacgttgcttggaagctctctggttttcaggtgaatc

SEQ ID NO: 15 - DNA, 95 bp, Arabidopsis thaliana
aactataattgttggctgagagagagagagagtcagattgttagaaagaaatctaatctttctttattatatattccctctaagtttaataatta

SEQ ID NO: 16 - DNA, 121 bp, Arabidopsis thaliana
agaaatcaacatcaatacattgacatcacattcataaagaagggtaatacgtacaaaaaaataaaaaaaaaataaaaagaatgcccatgatgtgtgtgtttgataatgtgatgggagataa

SEQ ID NO: 17 - DNA, 134 bp, Arabidopsis thaliana
tgtgtttggtgaatgtttggtctcaatgttttcagtttatggattaatgagatgagtatttgtgtttggtctgaatgtttgtagtttacggttttgtttcatctgttaatgtcatgatttgcttcattttgcag

SEQ ID NO: 18 - DNA, 79 bp, Arabidopsis thaliana
agagagtgaaagagagtgaatcttagttagctttgtaaggggctgagagggtgagaaatctctttgtaaatctctaaag

SEQ ID NO: 19 - DNA, 130 bp, Arabidopsis thaliana
acaatcatgagctttgaaaggagatttaccagagcacggaggcgctgagaagttacgttctgctgctgatcgtcgacttccaacatggccttagtagcttctttaccaagagttttcatacttgatttga

SEQ ID NO: 20 - DNA, 90 bp, Arabidopsis thaliana
tgaaagcactaggcttatacagtgactttttcagagcctggtacagagcaaagtgcagcttcttgtgctttctaatatcctctctcactc

SEQ ID NO: 21 - DNA, 77 bp, Arabidopsis thaliana
agtatgtagcagctatgattagtttattcggagaagcttcagataggctttgtcagaagcttgatgctgctgcattg

SEQ ID NO: 22 - DNA, 76 bp, Arabidopsis thaliana
tctacttgctggtgttcctggagctggtggatttgatgccatatttgcaatcactttaggggattccggcaccaaa

SEQ ID NO: 23 - DNA, 92 bp, Arabidopsis thaliana
tcttacttccattgtagaatattggtgttgttgaggtacatagagcagaagcttaatgaattttagttgcctgtataatctatataacatac

SEQ ID NO: 24 - DNA, 105 bp, Arabidopsis thaliana
atgatcggagagattttgacgacacgagtaagagaataagatatcttggaaagcaaggtatcgtcttcttcttcttcacctacgttgattctcacatcggttaga

SEQ ID NO: 25 - DNA, 89 bp, Arabidopsis thaliana
cgatctttagtctgtttgtttgatagagaagctgtttgtttgatagctgaagctcgagggtcaaatctttaaactagcgtctctgtttt

SEQ ID NO: 26 - DNA, 132 bp, Arabidopsis thaliana
aaattctttaactgttctgaggattgtttatgagagtattataagtcactacatttggtaagcaaagtgttgtttctcaaacgaagtgacttatgataatctcatgaatggattttgcaactcttaaagaga

SEQ ID NO: 27 - DNA, 103 bp, Arabidopsis thaliana
aatagtgttgtggacaagacaatagtgataagtatgtgatgaatgtgaatggaataaaggtcattttactttcgatgtacttgtttcttgtttttttgttcat

SEQ ID NO: 28 - DNA, 132 bp, Arabidopsis thaliana
agaggacctgaagccaagattgagagcgtgataaagacggtggtgaagagtattgatgtgggcagtggtgtttcctccctttgacgacgccatatctgtcgccggagttttcgttctgactgaaaattgacc

SEQ ID NO: 29 - DNA, 61 bp, Arabidopsis thaliana
aaggcatcatagttgtttgtgcaggagggaactctggcccagcggctcagactgtgttaaa

SEQ ID NO: 30 - DNA, 89 bp, Arabidopsis thaliana
cgtgatgggattgctaccggagcattccatgcagtcgcaaagggcattgtagttgtttgtgctggtggtaatgctggcccatcatctca

SEQ ID NO: 31 - DNA, 251 bp, Arabidopsis thaliana
tgagactgttggctttaatcctaccaataacttcagctgcatcatgaagagtagacagagattctggcggttgagggtttcttcgtagaggttgatcgattcttaatgtcctgtggattttaagttcccaaaactgttgcttaggacatacaagatcgttcaatgtccaagaagaaacctgagccgctacaatcatcggtctaatctctttagcagatgaagttatttgtggtataaaacccacagtttta

SEQ ID NO: 32 - DNA, 73 bp, Arabidopsis thaliana
tgtatcttgatgatggtgatgaagataccgttgctcaccagcaacgagatcaccatactttcaagagcattag

SEQ ID NO: 33 - DNA, 92 bp, Arabidopsis thaliana
tgactgtagtgcttcatcttctctatatctctgttgttatggtttaggatggagaaatggtgaaatcttgtagaagaagaagaagggaaggg

SEQ ID NO: 34 - DNA, 106 bp, Arabidopsis thaliana
tatgaaacatttgattagtgtactatgaatttttaatactttgaagataataaattgaagtgtttggttttagtactatatagatttacagttttgtatattggat

SEQ ID NO: 35 - DNA, 119 bp, Arabidopsis thaliana
ttataagcgctagaatctctgcctttggccatcttgatgatgatggtaatgatgattgttccgagctcatgaccatctcttgttgtggttgttgttgttgtttctgttctggttgatga

SEQ ID NO: 36 - DNA, 130 bp, Arabidopsis thaliana
catacctaaattgacatgaacatcatcatccactttcacgtagaactctgcgtcatacattgcagttgctgttgagaagtacagtcttgtctttgtcgagagttggtgatatccttcaatgtgttttagt

SEQ ID NO: 37 - DNA, 136 bp, Arabidopsis thaliana
aacctcaggctcgaattcgagtccggaacctgcgttaccagattgaagaggtagatcgagattcttcatcttcttgtgaggtctccatgtattctcaatcggaggaataacgtatttggggatggaattagctagg

SEQ ID NO: 38 - DNA, 91 bp, Arabidopsis thaliana
gcggaccgaggaatatgcgaatatgttgttgggagagataggattgcgtatcctaacaacgagatttggaccaaaaattccttagatcctc

SEQ ID NO: 39 - DNA, 101 bp, Arabidopsis thaliana
ttgtagacagattctcttgttgcttaagttaagtccatacccttagtgagtccctggtatgtggttttgatgtagctagaatctgtgctgggacatggaat

SEQ ID NO: 40 - DNA, 70 bp, Arabidopsis thaliana
aaaatcagaaggagatagagagagaaagagagaaacactctctaaatcttcttcttcttcatctctttcg

SEQ ID NO: 41 - DNA, 130 bp, Arabidopsis thaliana
gactaattggagaatacgaggtcttggtttcttataagattgtgatttattttgaaatttaaatatttgttttgacttaaatttgagattcagttatctaagaaacttcttcttcttcaacaatggcggc

SEQ ID NO: 42 - DNA, 83 bp, Arabidopsis thaliana
gatgaatgcgcgtgatcggcgacgcgcttccggcagagattaaactttatacggttgtgtgtgtgcttctggatctgtgtata

SEQ ID NO: 43 - DNA, 86 bp, Arabidopsis thaliana
tcacagaacccagaatagaaatttgttgttgttgccgacaaattggaaacaggtgagaggttgatgtttctgggaattgaatcaat

SEQ ID NO: 44 - DNA, 202 bp, Arabidopsis thaliana
tggttgaaggtggcaacaacctcaaatatactagaaggtgtagatactcaacgactataggaggcaatagcttgagcaaataattgattgcagaagtccatcgactaaagctgtcacctgtttgcttccagcttttgtctccttacctgttcagtgtctaaactctctggtacattcatagttgttgccgcctttgactttt

SEQ ID NO: 45 - DNA, 89 bp, Arabidopsis thaliana
agagtacaatgatgatgatgatgatgcattctttgcgacactagactttgatgcaatggaagcacaagccacattgttattgtcgaaac

SEQ ID NO: 46 - DNA, 82 bp, Arabidopsis thaliana
tacgatttcaccccggcggcggcgacggttcaagtttctgcatcgattccgcctcaaggagccggcgccggcgcctcatcct

SEQ ID NO: 47 - DNA, 79 bp, Arabidopsis thaliana
cttcccttttgcttactctcgttgatcatgaggttagatggtttaacagtttgtttctttctcatcttcatgctcaact

SEQ ID NO: 48 - DNA, 101 bp, Arabidopsis thaliana
atggtatgatgctgcgatagagtgatttggtgaagtgatgatatgatgctgcgatagagtggttttggtgtgtcatatccaagcacgatcaagctcggaag

SEQ ID NO: 49 - DNA, 68 bp, Arabidopsis thaliana
gaacaaatcatcatcttcttgctctgttgcggaaacagaaagcagaatggagaaggagacatgattca

SEQ ID NO: 50 - DNA, 124 bp, Arabidopsis thaliana
aagagcaaacttaaagagaaatctcttataactttcagtgatccagagtctgatgatgaaggtgaagagctgttaaacttcgtggcgtttatggcaagttctgattcaagcaaggttatgagtg

SEQ ID NO: 51 - DNA, 85 bp, Arabidopsis thaliana
gaggaagcgggaaagtagcagttgcttttgccagcgtggcatgttgattggagtgaaggaaaggcgtatcgctttagacaaagga

SEQ ID NO: 52 - DNA, 87 bp, Arabidopsis thaliana
cagaattggcgagagagtgttggtttgttgtcaatggagtacctataaggtactcaattagagagcatgcattgttgaccggtttga

SEQ ID NO: 53 - DNA, 182 bp, Arabidopsis thaliana
ggtcgagtggatgatgatggtgagactcggccatgttggtagagtgattggtcgagtgaatgatgatggtgatactcggccatgttggtagagtgattggtcgagtgaatgatgatggtgatactcgaccatgttggtggagtgattggtcgagtgaataatgatggtgatactcgacctgt

SEQ ID NO: 54 - DNA, 128 bp, Arabidopsis thaliana
tggaacatttatagaagcaaagagagaaaaaagttgagacctccgaggaattctgcagtattgatcttgggctgtggggtaaaggttagagcttgaagttcttgtgaaggtctaatggctccctgaat

SEQ ID NO: 55 - DNA, 104 bp, Arabidopsis thaliana
ggtttttgctgggccgaaactggtgtcgatcaacaccaacagtgtgtcggtcgacactcttcgctgattcctgaaccaaaattatccttagcttccttttcctt

SEQ ID NO: 56 - DNA, 82 bp, Arabidopsis thaliana
ggatttcatagaacaacaacagttgctctggatcatactgttggtgatcgcgactgttcatgtcctcttcatcatcatcgct

SEQ ID NO: 57 - DNA, 181 bp, Arabidopsis thaliana
gtcgagtggatgatgatggtgatacttggccacgttggtagagtgattggtcgagtgaatgatggtggtgatactcgaccttttggtagagtgattggtcgagtgaatgatgatggtgatactcggtcatgttggtagagtgattagtcgagtgaatgatgatggtgatactcggtcatgt

SEQ ID NO: 58 - DNA, 116 bp, Arabidopsis thaliana
acggtaggagaggttggtgttgttggtcttgaagttgttataccctttgtagccacccaggttgttgttgatgtagttaacttcttctaactggttaccctccccatcctggacct

SEQ ID NO: 59 - DNA, 138 bp, Arabidopsis thaliana
tgtccttgaatgatcttttgaatgagttgcttaatttcaggatcttgagttgctggggcttgttgtggttgttgagtgaaccctggtggtggattctgctgttggtagcctccattaaactgttgtttagggacataa

SEQ ID NO: 60 - DNA, 89 bp, Arabidopsis thaliana
actcgtccaggtgatcgagtgggtcttccattggcaggtcgtgaaatttgttcccctgaaccatagcaataagactgctcttgatctca

SEQ ID NO: 61 - DNA, 93 bp, Arabidopsis thaliana
aatgagttgcttaatttcaggatcttgagctgttggggcttgttgtggttgttgagtgaaccctggtagtggattctgctgttggtagcttcc

SEQ ID NO: 62 - DNA, 136 bp, Arabidopsis thaliana
ttgtccttggatgatctgttgaatgagttgcttaatttcaggatcttgagctgttggggcttgttgtggttgttgagtgaacctggtagtggattctgctgttggtagcttccattgaactgttgtttagggacat

SEQ ID NO: 63 - DNA, 103 bp, Arabidopsis thaliana
ttattcaaagcttgattataggggccaactagagcagctagtcgtaagccttcgatgtatttggctgtgttgttaccagactgtaaacaccttagcaaaaatg

SEQ ID NO: 64 - DNA, 136 bp, Arabidopsis thaliana
tgtctagttgagtgcggaatgaagaagactctgaagcttgtcatcgagtatgcagtcgagtggtggtgatggtgatactcgacttcatggtagagtgatgatcaggtaatggaggtgaagacactcgacctcgtgg

SEQ ID NO: 65 - DNA, 102 bp, Arabidopsis thaliana
gcagttcttgctcatctacaacgtcagccatcgtatttgtatgtgtctgttctcttagagagcgagcgatgcggtcgatgttgtcgttgaagaagaggttct

SEQ ID NO: 66 - DNA, 123 bp, Arabidopsis thaliana
gtgtaatggttttgatgtattgattagagtctgatgccaaacacaacttgttaagtgtcttgttttgatgagtgaatgtgtctgtgtcttaagcgtgtgtttttgtgtaatggtcttgtgtat

SEQ ID NO: 67 - DNA, 83 bp, Arabidopsis thaliana
attaccgtctctctctcctttcttcgttgagtgtttgccaagtaaggtgagaacgagctttggagatgaagatgaaggagaca

SEQ ID NO: 68 - DNA, 76 bp, Arabidopsis thaliana
aaggagatatgaatctgtgtggttttgagaagacggcaagggacgctcaacaaagacgcagcctctcattttctga

SEQ ID NO: 69 - DNA, 103 bp, Arabidopsis thaliana
gtaggagaggttggggttgttggttttgaagttgttgtatcgtttgtaaccaccctgattgttgttgatgtagctgacttcttccaactggttaccctcccca

SEQ ID NO: 70 - DNA, 110 bp, Arabidopsis thaliana
gcggtaggagaggttagggttgttggtcttgaagttgttataccctttgtagtcaccctgattgttgttgatgtagctaacttcttctaactggttaccctctccatctt

SEQ ID NO: 71 - DNA, 125 bp, Arabidopsis thaliana
tatgaagcggtcgagtgaagtttgagaggatgacagttgtaatgagagctcgagtgattttggtggtggagatgcgatgagagttgtggctgtgaaaggcgagagaggagcggtcgagtgcgtga

SEQ ID NO: 72 - DNA, 162 bp, Arabidopsis thaliana
gaggattagcgatgttggtgttgcggtagaagaggttggggttgttggttttgaagttgttgtatcctttgtagccaccctagttgttgttgatgttgctgactgcttccaactggttaccctccccatcttggacttgaaactgctcgtcatcaacaagga

SEQ ID NO: 73 - DNA, 94 bp, Arabidopsis thaliana
taaggggtggcacgaagactgtatctttggtctttgcagctgttggttttgcaacgaaggtagtagctggcggagcttgtggtcgagtgcgttg

SEQ ID NO: 74 - DNA, 97 bp, Arabidopsis thaliana
ctcaagattctgatagtaatacctgatgctgctggagtgttacgcgacaaagcttgtcagcatacaacgaagagggtcagaaaatagatgaacagtg

SEQ ID NO: 75 - DNA, 108 bp, Arabidopsis thaliana
tgaggattagcaacgttggtactgcggtaggagaggttggggttgttggttttgaagttggtgtaccctttgtagccactctggttgttgttgatgtagctgacttct

SEQ ID NO: 76 - DNA, 76 bp, Arabidopsis thaliana
tgaagttgtaagaagggaatctccagatccttgatttgtattccttgtcatggaagatatcttctacttcttctac

SEQ ID NO: 77 - DNA, 122 bp, Arabidopsis thaliana
cgttgatctcgatgatagttcactatctcttttttttagcaggattcgatggcaaatcattgatattgatgttggatgttgaaggaattattttatgtaggtcaaattaatcttaagactac

SEQ ID NO: 78 - DNA, 93 bp, Arabidopsis thaliana
ttttgattttttaacatgtttacttctttcattgttgcatgtgcttggaggtttactcgcgacagaggatctaaactggttagaaagatcaca

SEQ ID NO: 79 - DNA, 133 bp, Arabidopsis thaliana
tcttcttagtgtgtttagatctagttgtgggggagtttaggattaagggggagtttttaagctgtgtttgttaatcatgtccttttggtttagtaggtttttgtttctaagtactggataatgtgttttgaat

SEQ ID NO: 80 - DNA, 146 bp, Arabidopsis thaliana
ggaaaattacgagtttatgataatgttatcatgatgatagctatcaggactttggtatgttgatctgatgatgatggtggtggtattatgatattatgagagggtaatgatgatgatgatgatatgtgttgataatgagtaaattg

SEQ ID NO: 81 - DNA, 130 bp, Arabidopsis thaliana
tggttcttgacacatgatatgtaggcttaggtctgattgcataggataagattatgtgatgatatgatttgatgattattgagtgcttgatataatgatatgtatggtgataatgtttgactatgaaata

SEQ ID NO: 82 - DNA, 99 bp, Arabidopsis thaliana
ttcactcactcacacgggtctgagaagaagatgatgaagttcttgagtttttagagaaatttttgattttcactggtttcagaaagtggaacagagaga

SEQ ID NO: 83 - DNA, 131 bp, Arabidopsis thaliana
tgtgggaaggtatcataatgatgataaattgaatttggtctcgttgagcttgacaggtgatgttttgaagtggtttaattggaaaatggttaacgatgagtttcgatcttgggaggattttcgccaacgtc

SEQ ID NO: 84 - DNA, 130 bp, Arabidopsis thaliana
agctgccacaatcaaactctagttcttcgtcttcttcttttttttgcttagaaaacgtttgagattttgttgaaagatggaaacgttatatatatggactaatgtttttcaataggcaagtgtactttag

SEQ ID NO: 85 - DNA, 94 bp, Arabidopsis thaliana
gcgtatggttttgtttcctaagagtccttctcctgttaacaaagctagggttttgccaattagtgttgttggtggtgataaggatgaggaagtt

SEQ ID NO: 86 - DNA, 124 bp, Arabidopsis thaliana
tttgacaacgaccttgatatcctttaccttgagagccacgattgttggagcgggaatgttgtgtttgattctgctgtcactggttgttgttattaccacgagcagaggagcgattgttacagtt

SEQ ID NO: 87 - DNA, 133 bp, Arabidopsis thaliana
tatgagagcctccaaatttgacttcctcaccacttctccttgatcacttgcaacttcttgagatatgtttgcctttaacttagccggcttgagatgaggatgaagaatccaacatttgtccttcatatgaccc

SEQ ID NO: 88 - DNA, 114 bp, Arabidopsis thaliana
gaacatatataactaaatatccattggagggactcgcttagtctttggtgtgcttgatgtgacacgagtatcgaagaagaggaacaaagaatgggctcttgaacaacatttgaa

SEQ ID NO: 89 - DNA, 86 bp, Arabidopsis thaliana
catcatcatcatcttcatcatcctcatcaacatcatcatcatccataaggatgaagaagtacaagggagtgagaatgagaagttgg

SEQ ID NO: 90 - DNA, 131 bp, Arabidopsis thaliana
ttataactgattttgtcatttcttatatgtgagtttgagtttgtgtttgaattgattttgatgcatcatgcatgggtatatatctatataaagcgagagagagcatgattggttcgttattggagtctatg

SEQ ID NO: 91 - DNA, 85 bp, Arabidopsis thaliana
gacgaaactgaacccggtttgtacgtacggaccgcgtcgttggaatccaaaagaaccgggttcgtacgtacgctgttcatcgacg

SEQ ID NO: 92 - DNA, 68 bp, Arabidopsis thaliana
tgttagaatgatgttgttgcttgctgccaaaatgaagtggtcagttcttcaactagacatttctaatg

SEQ ID NO: 93 - DNA, 83 bp, Arabidopsis thaliana
gtaattagtccttgcacgaacattacgaaaaactgttttcggtttcggtttcattctgatgcttgttgtgtggtgatgtgaca

SEQ ID NO: 94 - DNA, 62 bp, Arabidopsis thaliana
gttgagagtaagagcgagtgagagagagagatgaatctctacacttttatttgtttttactg

SEQ ID NO: 95 - DNA, 133 bp, Arabidopsis thaliana
tttgaactatatcagttcatgttgctggttttgcaccgggaccggtggttcaaattgatggttctgatggtggtaatggagctgactttgagtggaactatggtcttggtcttgaaccaagacgtgagaggat

SEQ ID NO: 96 - DNA, 77 bp, Arabidopsis thaliana
agaaggttcctgaggaagaggaagatgctggtgagggtgaggccgaacccgaagctgctcctggtgctgctggaact

SEQ ID NO: 97 - DNA, 68 bp, Arabidopsis thaliana
attggtagaagagggaggtcacacattgcaccagaaggatcatctgtgtcttcttctttatcaactaa

SEQ ID NO: 98 - DNA, 103 bp, Arabidopsis thaliana
gtggcaaagtaagatatgggttttcgttgatggttttgtctgggagcgatctggatatgatgatgtttttgttaacaaatccatggttgaatttgtctcaagt

SEQ ID NO: 99 - DNA, 94 bp, Arabidopsis thaliana
aggcgctcgtgtgagagcttgacaatttcggagataggcactcgtgtgagagcttgaaaattttagagataggcgcttgtgtgagagcttgagg

SEQ ID NO: 100 - DNA, 133 bp, Arabidopsis thaliana
actttaaaatgattataataaatgaaaaaaggtattttggaataccttgattggtgtcacatatatgtatgtgatatatatacgcagacatatatatatttatgtgaacaagacagaggtttcgatttgcatg

SEQ ID NO: 101 - DNA, 112 bp, Arabidopsis thaliana
ccttaagagtatctctgaggctagatcgagaggaaaggacgaagttggttttgattgtaatcttcttcttctgtaaacttttctcttcttcttctcttgttgctccatcttt

SEQ ID NO: 102 - DNA, 60 bp, Arabidopsis thaliana
cgcacatacacaaacgcacgtgtatacatgtttttgtgtcactgtgtctgtgtatatatt

SEQ ID NO: 103 - DNA, 103 bp, Arabidopsis thaliana
actctattgttttgcaggattctcccctaagtgtctggatcaacatgtgccgaatttgttgttgattgtggtgaagatagggatcgtgaatatggtgattccc

SEQ ID NO: 104 - DNA, 85 bp, Arabidopsis thaliana
ccagacttctagtacattggaaatatgcattctatatcagtctgctggtatgtgtttgctattgctctgtgtttgtggagagaaa

SEQ ID NO: 105 - DNA, 122 bp, Arabidopsis thaliana
gaaaatctttaaactttttgcttttcgaagaaacatgactggtgttaatgatgatgatgataagaacttcaaagaagaaccagagattcaagttttaagcgacgacgatagtgatgaagaac

SEQ ID NO: 106 - DNA, 110 bp, Arabidopsis thaliana
gagtcgatttgtttacttataaaagccgcgatgtatgatgatgatgatgtgatgggttggcatcttctcgcgtgactaatgtcgttttaaaattagtgagccccgacaat

SEQ ID NO: 107 - DNA, 97 bp, Arabidopsis thaliana
agtctgattttatttgccatatggtgtgatataatgatcagctagctgcagtggctgcactctgtgtgcaatatgaggcaaatttcagaccaaacat

SEQ ID NO: 108 - DNA, 137 bp, Arabidopsis thaliana
agtttattgcgtcgatcaatgcattgaaagtgactacatcggggttccgattttttttgttcttcatatgatgaagcggaaacagtaatcaaccctggtttagtcactttcactgcattaatcaatgcatttgtaaa

SEQ ID NO: 109 - DNA, 67 bp, Arabidopsis thaliana
atgttttgcttctgctgcaacttctgctagagaaagtccagcagcagctgctgctccagcaacctac

SEQ ID NO: 110 - DNA, 79 bp, Arabidopsis thaliana
atttccttgggtgacctgatcttgatctgcatcttgttcgttcttgctgtggctgtcatcatcttctgcctttggaagc

SEQ ID NO: 111 - DNA, 122 bp, Arabidopsis thaliana
taagaaagaaaaaaaaaaaccaacttgaccttgaaaaaaaaaagcttgagcgtgtcaatgtgtgtttctccttgactcgtaatggaaccggtgagttgactcgtttcgtgtttttgtttttt

SEQ ID NO: 112 - DNA, 92 bp, Arabidopsis thaliana
gttgttgaagccgttgctgctgctgaagctggtacagttgctgctgttgaaagtgaaattgctgctgctgctgctgttgttgttgctggtgt

SEQ ID NO: 113 - DNA, 104 bp, Arabidopsis thaliana
aaatgccaatggtggtgtagctgttcccggtgctgctgcggctgaagctgcggcggctgcggctggagctgcggcggcggctgccggagctgcgcagcaaggga

SEQ ID NO: 114 - DNA, 108 bp, Arabidopsis thaliana
ttctaataacagcgatcatttactagtctcttcatgggataaggttagaaatctctaatcttctttcaaacattgattttactgctcctttgtaattctgatctctct

SEQ ID NO: 115 - DNA, 103 bp, Arabidopsis thaliana
atacggtatggctttgttcatctcaatttgttttgttttcttgaagcttctagcttttcttatttatgggattattggaggatgtacattaatggcctagtga

SEQ ID NO: 116 - DNA, 90 bp, Arabidopsis thaliana
gagaaaccgtcctagaggaaagaagaaatcttcttcttcttcgacgttgacatcttctccttcttcctcctcctcctattcatcttcttc

SEQ ID NO: 117 - DNA, 75 bp, Arabidopsis thaliana
ctgattgttgatgctgctgaaggagtgatggtaagtctttactctctcttttttggtctgtatttttaatttttt

SEQ ID NO: 118 - DNA, 108 bp, Arabidopsis thaliana
aacttcttggtgcgtcaattttacttttatgtggtgcatatttgtagtctataacctatatatatttatgcagaaatttcaaggtggtaagataggaacaaccttgat

SEQ ID NO: 119 - DNA, 98 bp, Arabidopsis thaliana
acaacttctttgatgactttgctcatgttgctgatgatgagagtcgccatttcttgtggtgttcccagagactcgctgagcttggtttcaagtctgtt

SEQ ID NO: 120 - DNA, 110 bp, Arabidopsis thaliana
taaaaatcatcgattcaagataaataaagacaagattggtgatggtggtgcatcagcttcaacagaattaccacttagtcagttgtttaaaaaggaggtgatgaagagaa

SEQ ID NO: 121 - DNA, 75 bp, Arabidopsis thaliana
tgaacgaagcgctggtgaagaagttcaagaaggttacacatctctctttgactttgtctctctgtgcttttgatt

SEQ ID NO: 122 - DNA, 153 bp, Arabidopsis thaliana
aactcttaataggaaatattttactaacagaggcttagatgcagttagttttgtgaaagggaggaagttgtagttttttttttttttttttaactcgcaagttgtacattcttggtatgctgctttccatagcttttggagtttaatattttt

SEQ ID NO: 123 - DNA, 125 bp, Arabidopsis thaliana
ttcttttggcttttgagatatcatagagttttgttggaactcaaagaccaaacagtgcaatgatgattttggggtcttgagtaaatttacaaacccttttaggcatattataatagtcttctgtt

SEQ ID NO: 124 - DNA, 122 bp, Arabidopsis thaliana
atccaattgtaaacttcacagcatcatcgtcatagtagcccataagttccgaagtcttcatgttggttttgaattgcagtgcttgaatgacaccggatgcatcatcatagtaaccatcaata

SEQ ID NO: 125 - DNA, 102 bp, Arabidopsis thaliana
aagtggaagattaataattaagaagctgaagctgaagcagaagaagaagcagactctctctctctctttgcttcagcttttgcgcagctctgatctctgaag

SEQ ID NO: 126 - DNA, 104 bp, Arabidopsis thaliana
agagaaagagagaaagagaaagtttctgatgaatgatgaatatgtgtgtgttgaaaaaaagagaagcatgtgttatgttgcagagagatttttcgtacttgtac

SEQ ID NO: 127 - DNA, 115 bp, Arabidopsis thaliana
attaaagaagctgaggagtatttcttgatgtcttcttcgtcttcttcttctggtttgatatcgtcgagccacaagatggagaagaagatttgcaagaagctgaaagaggttcagg

SEQ ID NO: 128 - DNA, 132 bp, Arabidopsis thaliana
cttatttaactgcattgcctgtgagttgtggtcctgaaggttgttgttattattgaattctatgtatgtatagattatgtcattggtctcatgtggtttttatgggtaacgtctttactaataatagcacta

SEQ ID NO: 129 - DNA, 139 bp, Arabidopsis thaliana
gtgtcttgttctatatctgagttctgtttctgtaactatgtattttttggtaaaaggatttttacttttgttctctgtatattgaagtgcacgcaatggaagagatgaaactcactggaaatcatctcaaagggtcacg

SEQ ID NO: 130 - DNA, 122 bp, Arabidopsis thaliana
cagttcccatgcactacatcacagaattttgtgcatgcttttccatagtcttgtcattcaaatgtttgaacttgttaagaattttattatgttgagttctcgcctgtgatggtttggtgtta

SEQ ID NO: 131 - DNA, 105 bp, Arabidopsis thaliana
ccagaagtgattcagaactccgaaggttataatgagaaggtatctcgtccatctgctgtagcttttgttgttcttctagtttacccaatcttctgtgtataccct

SEQ ID NO: 132 - DNA, 83 bp, Arabidopsis thaliana
atggtagggatgatgatggtggagatcgtcagtggtcatggactgctgatgatgatgatgatgatggtgaggatcaaaccaag

SEQ ID NO: 133 - DNA, 89 bp, Arabidopsis thaliana
tggtccctgatagttctggttcatgtttggtggtggaggaggacctctgtagttctggttcatgttaggtggttgtatatgaggaggca

SEQ ID NO: 134 - DNA, 86 bp, Arabidopsis thaliana
caagaacaaggacgataatcacagaggaatcatctccacagatagagatatcaagagctctgctgttgttgttgatcctcctctca

SEQ ID NO: 135 - DNA, 129 bp, Arabidopsis thaliana
aaccatttgttttcaacctacagtgtgaatatacttttcagaaagtaaattagttactcatgtttgttttcctttagatatttgacattagttgaggagatggtcgaattttcaagtttcccactaaga

SEQ ID NO: 136 - DNA, 78 bp, Arabidopsis thaliana
agattcgaactttataagggttcttgcagaagcaaacctggtgtttaaacccatcaaattggttgtttttgagagaat

SEQ ID NO: 137 - DNA, 85 bp, Arabidopsis thaliana
ggagggatggtaataacatgatggtcacaacggtggtggtgatgatagtgaaagtggtagttgtgatgatgttgttacttatgta

SEQ ID NO: 138 - DNA, 98 bp, Arabidopsis thaliana
ttctcttcttctcgattcatcgttatcttcttcctctttcgcttcttcttctcgtacggagcttgaagatgacacttgcgatgacggtaacgaagaag

SEQ ID NO: 139 - DNA, 133 bp, Arabidopsis thaliana
gcttttgtaggagcggcatcagcagtagatgatggggtgtaatctttgaactttccaatgtcctcttcatcttcaactgtaatagcaattacctatttgaaagcaaaaaaaaatgacattatccaaataattt

SEQ ID NO: 140 - DNA, 101 bp, Arabidopsis thaliana
taaacgattttgattgtaaaggcaacaatgtaatctttttctttttgttgataaaaagtttgtgcattgcatttgcagataatttttttgtagaatttaat

SEQ ID NO: 141 - DNA, 129 bp, Arabidopsis thaliana
tttatagattttgagcttgacatgaatggaaagcgcttcgcctggcaggttcatggttgtttgtattctttggatatagtattgatgttatcatgctgagactgtgtattttgttcttcagctgttgat

SEQ ID NO: 142 - DNA, 85 bp, Arabidopsis thaliana
gtaaccgtgctcgctgtggtgtggtttgtgcatggctgatcttcgagcttgtcggcgatctcatcagccacacaatcagccttct

SEQ ID NO: 143 - DNA, 133 bp, Arabidopsis thaliana
tttttggttatcagattgatgatcggacggttcttattggtttatcggttttgacggttgtgatgcttttgttgactcacgctacttcgaatattctgggatctttgttaaccgccgccgtgttggttctgat

SEQ ID NO: 144 - DNA, 98 bp, Arabidopsis thaliana
aacaaatgtaacccacctcactgtcttgctctctcttcgtctcgcctgtgatctgttaaaggccagacgtgagttctcctttgcatgactctgaaaga

SEQ ID NO: 145 - DNA, 88 bp, Arabidopsis thaliana
aatgaatggatcagctcctgttaaaccattgaatcagagtgcactgtatggaaacagtgctcttggaggtggtcttgctgctggttat

SEQ ID NO: 146 - DNA, 96 bp, Arabidopsis thaliana
aacacgtcatctctgtgcttctttgtctacacttttggaaaaggtgatgatatcattgcttttccccaaatgtagacaaagcaataccgtgatgac

SEQ ID NO: 147 - DNA, 97 bp, Arabidopsis thaliana
aaaatttcggcaatgagaacttcagtgcttttctttttcagctcatgggaagatgacgttactggtagatcagctggaatttcagaatcaaaattaa

SEQ ID NO: 148 - DNA, 133 bp, Arabidopsis thaliana
tttccaattgcaggaggaagtgagccagtgagaacattttgacccaagttcctgaaagaagtgattttgatttgtgaaaatttgtgctctttttcttgtagcttaatctatataatcatcaagtaatagtaaa

SEQ ID NO: 149 - DNA, 101 bp, Arabidopsis thaliana
atgtgcttgcatcttgcttttggtattgctgattttgttgatctctggatcttgttctgtttacagtagtatcatggctatgacatggtctaatttgtttt

SEQ ID NO: 150 - DNA, 103 bp, Arabidopsis thaliana
ttaaaacaaaattgtgttgaatcaaaactattaaacaaaaatggtgagtatcatgaagataatgatgatcatggttttgttagtggttggcgtcagtgcaaag

SEQ ID NO: 151 - DNA, 90 bp, Arabidopsis thaliana
tatatcattatcatgtgaggacattgtcgatgaagattgtgttcttctctggatctttctcgtcttctcttccatggctgaccgctccac

SEQ ID NO: 152 - DNA, 141 bp, Arabidopsis thaliana
ctgtttccattttgcgtatcgattattgtgagtgttcatgacttctctttgattgagtcaacactttttttttttttttatcggattctggttctattagtcgacgatagaagcaagcactgaagcgccggtgtagctccg

SEQ ID NO: 153 - DNA, 89 bp, Arabidopsis thaliana
aaagagtcaaaatgtttggaaagagatgatgattagttatgacatcaagttctctatttgcttgcaaagatgtcttgttgactctacaa

SEQ ID NO: 154 - DNA, 181 bp, Arabidopsis thaliana
ttaagttaagaagagaataagattcttacatcttgatgaagaggaatgggaagccgaaatctaaactgaaacagaggcgtcacccaattatcaattggtaagtgatatctatgtttcgatctgtatctcggcctttcactcctcttcttcttgatgtaagaatttgttattcgacacatta

SEQ ID NO: 155 - DNA, 136 bp, Arabidopsis thaliana
taaggttactgggaagtgtggctctgttactgtgagaatggttcctgctccgagaggttctggtattgttgctgctagggttcctaagaaggttcttcagttcgctggtattgatgatgtctttacttcttccaga

SEQ ID NO: 156 - DNA, 120 bp, Arabidopsis thaliana
tccacttctgatatgtctgtaaatgttgcagcttccactttactaatcaagatatggatatgatctctgtgtctgtcagtgtcagatttaatctgcaaatgtgcaaacaccgttaggaga

SEQ ID NO: 157 - DNA, 98 bp, Arabidopsis thaliana
gcgacggaggagtaggaggagaagtcgccgatggtgttagaggtggctctggctcgtctttggttttgtttctctcatatcacacaaaatggatattt

SEQ ID NO: 158 - DNA, 123 bp, Arabidopsis thaliana
tatgaaagggaaattagtatatatatctacgtgacatattgccatcttctatactgtggttattgtcaatcttgtctctgcttatcgactggtcagtagttacgtggtgctaaggtccaacta

SEQ ID NO: 159 - DNA, 107 bp, Arabidopsis thaliana
ggggaggtggagccgcagcagatggtggaggtggtggtggtggtgaagtttggtttgctggaccaggcggtgctggtggagcatttgccgtggtgaattgacccgga

SEQ ID NO: 160 - DNA, 124 bp, Arabidopsis thaliana
aaggtagatgtcgaaatctctctgttgtgaagtcaaacatgagtatgaattaacattaatggatctttttgattcataatactcatgtttggtttcacagtagatagatatcgacgtctatctt

SEQ ID NO: 161 - DNA, 126 bp, Arabidopsis thaliana
gatcatatgcatggattcatttcagatggctgtttgggtaactaatatttaagattttggtcaatttaagttaccaatttatatattggttacccatatggccatctcaaatttaatccgttaaaa

SEQ ID NO: 162 - DNA, 94 bp, Arabidopsis thaliana
atatttcgtacattagaagatgagaagatgcagaagaagcagaggaatagagttgcttcaatattgttcatcttcttggtgagagagatttgtt

SEQ ID NO: 163 - DNA, 82 bp, Arabidopsis thaliana
gatcacagctatcatctttctctccttggaaatagcaaaaccggagtgaatgacaattggagagagtggtggattagatcca

SEQ ID NO: 164 - DNA, 114 bp, Arabidopsis thaliana
cttccgccatgaatctctctgtcacaactatctctgtctcttcacttctctatgaggtgactcttgtagagctatgaattttttagtggagttgttgttgttggtggtgatggt

SEQ ID NO: 165 - DNA, 125 bp, Arabidopsis thaliana
catcacaccagaaggtgagctagaggttgagtgtgacgacgacgtctacgttcttgatgctgctgaggaagctggaatcgatttgccttactcttgccgtgctggttcttgttcgagctgtgctg

SEQ ID NO: 166 - DNA, 91 bp, Arabidopsis thaliana
ttaacttcgctcttgatgggttgaagaaaggacataaagttaggatcagaagagctgctttgtcctctctactctcgatttgtgaatctca

SEQ ID NO: 167 - DNA, 121 bp, Arabidopsis thaliana
ggtggtggtgccgcttgagttcctggaggtggaggaggcggtggtggtgccgctgcagttcctggaggtggaggaggtggtggtggggccactgcagctcttggaggtggaggcggtggag

SEQ ID NO: 168 - DNA, 79 bp, Arabidopsis thaliana
aaaccggttgaacaggcttttaaatccgatatgcatgcatggttgtgattttcaagcactctttgttgttccaatggtc

SEQ ID NO: 169 - DNA, 134 bp, Arabidopsis thaliana
gaaaagagaggctataagcgggatgatgaatccgaccatgatggtgttgcagaaatttatgtatgatgtagttattgtccagggatcgaaacaccatcatggtcagatccgtcatcccacttatgttttcttag

SEQ ID NO: 170 - DNA, 144 bp, Arabidopsis thaliana
tatgatggttgtttctgtgtgtatatgtctctatttttacatctagagtgttgttgtgaagcgtagatagatatgtgtgtgagtgatacaggctttagaatcttgtggagagatattggttttggtgtttacatgaaaaaacat

SEQ ID NO: 171 - DNA, 65 bp, Arabidopsis thaliana
ctccttcactgggtttggttttgccgcagcttgtgttgtgtctgttttacttaccggtggaggat

SEQ ID NO: 172 - DNA, 147 bp, Arabidopsis thaliana
tgaaatttggttgggattatagccacgaactcaatagaattcttaagatcatgtgaaaacgttgacaagatcgtctacgattttccaagattctaagtcttctattgatgttcatggctttaacctgattttttttttcctactaaa

SEQ ID NO: 173 - DNA, 73 bp, Arabidopsis thaliana
tcgagcatgaaactgatcttgagatctgtcttccggtaatggtttaggtattttcatgatgttgttgcttgat

SEQ ID NO: 174 - DNA, 122 bp, Arabidopsis thaliana
aagaaaccgagactaatttctttacaaagatttaaagaatatctgaatatgtatgagtgtgtcgaataaagagcatgtattaggtttaagtatcagatcttgtaagctgattaaacctccat

SEQ ID NO: 175 - DNA, 81 bp, Arabidopsis thaliana
tttatcgaccttattctgtaacttgtgtttctgtttcagtgctttgactgaggatatttgttcttgacttagggtcacttc

SEQ ID NO: 176 - DNA, 77 bp, Arabidopsis thaliana
agtttgtgtgtctatataaacttaactacattcttgaaaagaagagtgatatgacattgtgtagatatatgtatatg

SEQ ID NO: 177 - DNA, 97 bp, Arabidopsis thaliana
tcaatatcatgaaacacattaaagtactataaatttattgggaaaccctaaaagagtaagtaactgtgtgtgtgtatctatggtttaatttaattat

SEQ ID NO: 178 - DNA, 111 bp, Arabidopsis thaliana
acttttaatattcatcatcatcatcgcgccatgttgctttcttcttctgcttctgtttcttttccaagtttttaaagagagagagagagactgaaagaaaaacaaaaaaca

SEQ ID NO: 179 - DNA, 93 bp, Arabidopsis thaliana
attctatttggagatgctgctggtgctgtggttgttcaggtactgtgccttatgaagcttttgagcaatttcgtgcacttatatccaaagttt

SEQ ID NO: 180 - DNA, 103 bp, Arabidopsis thaliana
tgcttgcattgcaagttaggattgttgttgttgaatgcattgaggccacaaggcaatgtctgctggtgatggtggcggttataatgatgattgggaagaaact

SEQ ID NO: 181 - DNA, 132 bp, Arabidopsis thaliana
tatgatgttatattcgaaattgagtattacttgaccatttgttttcataatcaaacgtaaatgcatatacatgttttatacgttgagtatgaatacgatcaacgttattgattctttagcgaataaatgtcc

SEQ ID NO: 182 - DNA, 134 bp, Arabidopsis thaliana
ttgaagctagatgatgcggttgatctgttcggtgagatggtacagtctcgtcctttaccttccattgttgaattcaataaactgttgagtgccattgctaagatgaacaagtttgatcttgtcatctctctcgg

SEQ ID NO: 183 - DNA, 98 bp, Arabidopsis thaliana
aagaaataattaaagacaaattcttactcaccttttttttttatcttctttgttctgagccaagagattgagagaagagagtgtgtgagaaaagcctt

SEQ ID NO: 184 - DNA, 68 bp, Arabidopsis thaliana
ccattcccctttcctcttccgcagctcatatcagatgcgctgcagctgcggctgctgcgactaggggt

SEQ ID NO: 185 - DNA, 103 bp, Arabidopsis thaliana
ctcagtgaatcttggtggtttttacttattgttatgttcttgtggtttcttaggaagttgagagaatcagaaacgagcatcccgatgatgttaccgcggtaac

SEQ ID NO: 186 - DNA, 111 bp, Arabidopsis thaliana
ggaaactttactggtcctgcttttggtttcttccctgctgctgctggtggtgctacaacattttcatctaccggtttcggtcaacctaatgcgcctttccctggtttcgat

SEQ ID NO: 187 - DNA, 73 bp, Arabidopsis thaliana
tccacctcttgaacttgattctgctgctgttgtttcaacttcaacatcatctccagttcaagctcttggacat

SEQ ID NO: 188 - DNA, 108 bp, Arabidopsis thaliana
gtttgttaggacggcataacatttataatattcttgctgctgtggctgttgggattgctgttggagctcctcttgaggatattgttagaggtgttgaggaagtcgatg

SEQ ID NO: 189 - DNA, 111 bp, Arabidopsis thaliana
acacggtagcttccgtagccgcgacggagcagattatgtccgtgacttggcttcgtaagctgatggatgttttcctctgttgcgaagctgaattcaaagcgattttgttaa

SEQ ID NO: 190 - DNA, 76 bp, Arabidopsis thaliana
ggaatcgatcatggagaagatctctgagaagatccatggtcacgatgactcttcttcttcttcttccgattcggat

SEQ ID NO: 191 - DNA, 79 bp, Arabidopsis thaliana
ttgcttgaagaggcttgcaatgtcggtaatccaaacccttgcctccaaccacacgttgcagattcttcattatttgcac

SEQ ID NO: 192 - DNA, 109 bp, Arabidopsis thaliana
actagtaagaaagataaacggtgcactccagaacagtctcgagcccatctgtgaactggtgcggctgctgctgctgggtcccggaggaacccgtaaaagtcttgacaat

SEQ ID NO: 193 - DNA, 102 bp, Arabidopsis thaliana
taatatatatatatatatatattacttagcttgtagggttttgtaatcctagctagctaggtccttgttatgtaatatatacatatatcaatcaaaaacatc

SEQ ID NO: 194 - DNA, 104 bp, Arabidopsis thaliana
gttgttgatcatcttcactatgcgatgtttgcgcttcttgttctcatgtgttttggagataagcttgacgagaagcaaataaaacaagtggaatatgttcagag

SEQ ID NO: 195 - DNA, 128 bp, Arabidopsis thaliana
tgttcctggtgatattgtggaactgagggttggtgataaggtacctgctgatatgcgtgtggttgctttgatcagttcaactttgagagtcgagcaggggtccttaacaggagagagtgaggcagtga

SEQ ID NO: 196 - DNA, 129 bp, Arabidopsis thaliana
tggtctcgtttttgttattgtaactgtctcagagaagctccacagctagcatccgtgttgagagaaatgaagaatgttctagatgtggttaggagcaaagtggaagctctgactgcattggtacgtaat

SEQ ID NO: 197 - DNA, 105 bp, Arabidopsis thaliana
aataattgaccaaaatgctcttgacgaaactgaacccggtttgtacgtacggaccgcgtccttggaatccaagagaaccgggtttgtacgtacactgttcatcga

SEQ ID NO: 198 - DNA, 60 bp, Arabidopsis thaliana
tatatatagagaagaaagacagagtccgtgatcactcactctctctctatctctatatat

SEQ ID NO: 199 - DNA, 87 bp, Arabidopsis thaliana
agatggttgttgttgctgctgctgctccgggttactactctcactcgtgctcgaaagtggcagcgtcaaagacgatgattcaagatc

SEQ ID NO: 200 - DNA, 81 bp, Arabidopsis thaliana
attatgaaacttgcagttaattgatgtgagagcttgagtttctcaagctttggagcatccaatataaccactagatcatca

SEQ ID NO: 201 - DNA, 445 bp, Arabidopsis thaliana
agtccaaatctaatccaggaacatacctccagagatgtcttcattcgggggatacgacactagtcttaaccatatcttttgtcggaagattcaggagaacatggaagagcaaagattctagcaaatctcttacccaatcaacttcatcaccagatcttttgtcggaaaattcaggagaacatgatcgtttggtacgaatacaagatctggtgagaatggacgaagaaggaaagagagacgtgttcgtaccaaacgatcatgttctcctgaatcttccgacaaaagatctggtgatgaagttgattggttaagtgatttaccagaagctttgctcgttcatgttctcctgaatcttccgacaaaaaatgtggttaagactagtgtcttatccaacaaatggagaaatatctggaggtatgatcctggattggatttggataatcgt

SEQ ID NO: 202 - DNA, 88 bp, Arabidopsis thaliana
agaaacacgagactttttctctttggttttgactgatttttgaggtccttaaaattaataccgaaaccacttcagaggttaagatgtc

SEQ ID NO: 203 - DNA, 139 bp, Arabidopsis thaliana
agtaatgttcttgtctctctgtgatatcctgttagtagcaccatgaaactgtatatattgtaagtagatatatatttactatcttttgttgaatatacaaggttattgtacgcaaatggaatcagcaagacgagtggtt

SEQ ID NO: 204 - DNA, 144 bp, Arabidopsis thaliana
tttgggaggcattgatagtgttgacagaagatagagagcacagatgataagatacaattcctcgcagcttctttgcatcttactcctttgtgctctctagccttctgtcatcacccgttatttgccatcacccatctttttcac

SEQ ID NO: 205 - DNA, 95 bp, Arabidopsis thaliana
ctgggagctcttcaaagcatgctttgatagggaatggttgcttatgaaacgcaactcctttgtgtatgtgttcaagaccgtccagataacaatca

SEQ ID NO: 206 - DNA, 107 bp, Arabidopsis thaliana
tgagagcgtatcacttccatttttactgattctacttcttcttcaccgttctctattcgtgagccaaagaagaaagggttcgtcgagaaaagcgcgggaaagatgca

SEQ ID NO: 207 - DNA, 132 bp, Arabidopsis thaliana
tccacacgtctcatatcttacttatacagctttattttcctctgtaactacttaacgtcagtgcttttgtttacttaattggaaactgcactgtgatgcaggtgaagaagctggctgatcttgttatatggc

SEQ ID NO: 208 - DNA, 87 bp, Arabidopsis thaliana
aaaattacaggaaacaagggctttacgagttgactggttcaaactaattgagagagtcacagagagagagagacgttacctgtaatc

SEQ ID NO: 209 - DNA, 131 bp, Arabidopsis thaliana
acgatgatgatgagttttatgctgaaggaaggtctcaggcaccattgtttctattgaaattcttgtttgatatcttcttattactcagtacgcatttaaattaatcatcagagggattatatctacgcatg

SEQ ID NO: 210 - DNA, 98 bp, Arabidopsis thaliana
catatgtttccatttgtagagtcttcttagttcttgttgttgtcatgcagggcgtgagcaagggacttatagcgagaaggatgctttcgatgatgcaa

SEQ ID NO: 211 - DNA, 108 bp, Arabidopsis thaliana
tttgcgttgcaacgaaaataaatattatttgacaagtttttggctgtgtttaaaaaaaaaaaaaaaaaagttttatatatgtgtcaatgtttgttttagtttaacgtt

SEQ ID NO: 212 - DNA, 132 bp, Arabidopsis thaliana
atgcatctttgagtaataatggaagaagattgtggtgcttttgcagcagattgtgttatcttctgttgctgctgcgagtgttttatcttacaagtctttatctttattttctttaagattccttgtaaactt

SEQ ID NO: 213 - DNA, 88 bp, Arabidopsis thaliana
tggttatggaaatgaatgttgtacgtcacgttatactatagatatatgtgtgtttgtgtgtatgtataacggaagtatttgtatccgt

SEQ ID NO: 214 - DNA, 76 bp, Arabidopsis thaliana
tcaaacaattaagtttgcacctgccacaggacaggggaaagtgcagctgcaacaggtgctgaaggtgcagatggag

SEQ ID NO: 215 - DNA, 103 bp, Arabidopsis thaliana
tgattctgttccttttctcaatatattgatttgggcttctcttgttcttcatcgaatcattggtcttcaaggtgaatgtgtttgtgtagtggcaagtcttgtt

SEQ ID NO: 216 - DNA, 121 bp, Arabidopsis thaliana
aagaagaagaagaagaagaaacagaaaacaaggaagatcagaaatggtggcggtgatggcgatggtgatggtggagatgattcatcaccactttttaaagtggttcatcaagaatgatttt

SEQ ID NO: 217 - DNA, 73 bp, Arabidopsis thaliana
aagagtttattctggtagatgatgatgatgttatcattcttgattttcctgagtcatctaaacggaaagctcc

SEQ ID NO: 218 - DNA, 109 bp, Arabidopsis thaliana
cagaacttatcctacatgcttcgcgtagtacttcttgtaaatatgcttgtacatatactgatatacatacacatagacataagaatgatgcaccatgcaggacacagaa

SEQ ID NO: 219 - DNA, 118 bp, Arabidopsis thaliana
tcagctatttttttggtaaggttgtgttgatctttcatgatgtcctgaaagaatatcttctgtctatctttctgtcatgaaatgttctgaataattattccttggtgggtgaaatgaa

SEQ ID NO: 220 - DNA, 127 bp, Arabidopsis thaliana
atttcctcagatattgtttcacaagacaaaatgaaaagaaaagatttctttttatctagatacatattggtgtttaaaaaaagatacattttattttttctagttgtagaaaaatgtggatgttcaa

SEQ ID NO: 221 - DNA, 108 bp, Arabidopsis thaliana
gagaatcttgttggtggtgaagacaacttgtttgatgatgatgatgggtttatagaactaaacccaagtttacagatttcaaactttgcttatggagaagaagaagaa

SEQ ID NO: 222 - DNA, 110 bp, Arabidopsis thaliana
atcttttaagagagttagaacttggttgtacgaggaagaagatgaagaaggcttttgtcttttcgtttcttcttgtgttttgatgatttcttgttcttgctcatctcttt

SEQ ID NO: 223 - DNA, 133 bp, Arabidopsis thaliana
aaagtcaaatgtccccttgagttcccttaaacgcttcattgttcatactttgttatcatctatcgatcgatcaatcaatctgatgaacactgaagtgtttggggggactctaggtgacatcttggcacccaca

SEQ ID NO: 224 - DNA, 139 bp, Arabidopsis thaliana
gtagatgtatgtatcgtgacagctccgtaatctaacggccgttccattattgaataactccattcttcttcttcttcgttaaggacacggtgagattttgttatgattgtctaactatttatacaatattttctagtct

SEQ ID NO: 225 - DNA, 86 bp, Arabidopsis thaliana
atcgtgattcagagacgtattgttcttctgtcatatgcaataagtttaattagagaacaatacgtctctgaatcgtgattgttttt

SEQ ID NO: 226 - DNA, 85 bp, Arabidopsis thaliana
aatctctgatggcatctttctctgtgttctagtttatattgatgatatcatcattgctagtaacaatgatgcagcagttgatatt

SEQ ID NO: 227 - DNA, 92 bp, Arabidopsis thaliana
gtatagtgccgatgcagctggtggcgatgcttcggttgagctgactaggcggtgtaggcatgctgctgctgcagtcggtgatttgatattta

SEQ ID NO: 228 - DNA, 122 bp, Arabidopsis thaliana
tcaccattcttttggagggggcttacaaataaaactgttcttttgatgattacttttgttgtattgttgcatcgtgtgagattagttttgaattaagcatcgtccaactatgaaaaacttac

SEQ ID NO: 229 - DNA, 114 bp, Arabidopsis thaliana
ttcatagagagcaacaaaatcagtgtgtatttgttaagacaaatgtttatataagtcgtccatgcgttgtacatttaatcttaactaatacgcattgagtttcgttgctttctc

SEQ ID NO: 230 - DNA, 137 bp, Arabidopsis thaliana
ctcaagctcggaaagcatccttggctcggttcttggagaagcgcaaagagaggtttgattttgtattttttttctttatagaaaattttgaggtttttcaattgaatctaaaagaattgatgttgttggtgcaggct

SEQ ID NO: 231 - DNA, 100 bp, Arabidopsis thaliana
ttttctcttacttcttcaaagctgtggagataacctcagtgtatttgttgatgtattcatgcagctccaatgagtccaccaggttcttcagctcgtttgt

SEQ ID NO: 232 - DNA, 104 bp, Arabidopsis thaliana
tttgggtgtcttgtgaatatggatgttaatgtgaatgtgagctttttttgttggaaggtccaaaaaacaaatctctttcttccactggcccttttgcttctcca

SEQ ID NO: 233 - DNA, 106 bp, Arabidopsis thaliana
tttggttaatgggaaaatggggattgttaaggatgatgatgaaggtgttgagattgcggagtttgctcggcaaggtaggccggtggtggagattgggacggttgtt

SEQ ID NO: 234 - DNA, 68 bp, Arabidopsis thaliana
agcagcagcagcagcaaccgccgcaacctgactcacggcagggaaaggaggaggagcagcagcagcaa

SEQ ID NO: 235 - DNA, 69 bp, Arabidopsis thaliana
ccgcagccatagcgataagatttctaggtttttctagggtgagacagagagatttctgtttgtggtttt

SEQ ID NO: 236 - DNA, 106 bp, Arabidopsis thaliana
atgaaaatttatgtcttgatcttgtgattctgttgtttctacattttgctgaaagttttgagatttgcagtggcaggtaactctggaggtataaggattcatgcgg

SEQ ID NO: 237 - DNA, 128 bp, Arabidopsis thaliana
tggcatcttgatttgttttcaatgaaattgagagttgagtctgtagaatcggcgatggtttgttgaattgagagtttctatgattcgtttgtttagatggaacttgaagaggaaagagatgatgaagc

SEQ ID NO: 238 - DNA, 97 bp, Arabidopsis thaliana
gttatttttgtttaggttttgatcatgaagaagaagatttgatattatctttgggtttctctttcatattaaacatagagaaagatgaaaatttctt

SEQ ID NO: 239 - DNA, 98 bp, Arabidopsis thaliana
tccagtagaaatcataatgtatcatcttcgtcgtcatctatgaggtttattgttgaggaggaagaagcaaaatctccaatgacaacgaggttgaggtc

SEQ ID NO: 240 - DNA, 136 bp, Arabidopsis thaliana
gtggctgctggtttgttggttctgattctgatttttctccatgactgaagcaatggtacttgttggtgatgctgctacttctggtctcttctctgcatgacttagatctgaacatcttcacttgcaaacaaacctc

SEQ ID NO: 241 - DNA, 96 bp, Arabidopsis thaliana
accaagcgagctagaccgacatcactgattttgcaagtgagatgtttatcgagtagaatgtttgctggcttcagatcacggtgaactaggggctca

SEQ ID NO: 242 - DNA, 86 bp, Arabidopsis thaliana
tttgtgtctctgtttctcaagcttaggatctttgtctctgtttctgtttcagggaagatgactcgaagctggtcgatggaattact

SEQ ID NO: 243 - DNA, 132 bp, Arabidopsis thaliana
ctttgggagcctcttcagtagcaggggtctcgaaagtctctcccactacaagatctgggacatcatcatcatcgtcctcttcttggattgttgctgggacatcacctgcacctggagcttgtttctggaatt

SEQ ID NO: 244 - DNA, 101 bp, Arabidopsis thaliana
tccgagaccttccaactacgaagaagacggtggtcctgctaaaccgacggctgctggaactgctgctggagctgggaggtttcattatcaatctggaggaa

SEQ ID NO: 245 - DNA, 77 bp, Arabidopsis thaliana
taactcatcgagctgttcttcatatcttgtgtcagcggaaaatggttgcagaagttgaagctgtgatagctgagatg

SEQ ID NO: 246 - DNA, 113 bp, Arabidopsis thaliana
aaaacagcaatgtttgggtaagttttgaatctttttactattaataagagacatgtctatatgaaaatgtgcatgcttatatttaggatatatgtgcagaagtattgctgtgc

SEQ ID NO: 247 - DNA, 93 bp, Arabidopsis thaliana
caatccaacttggaataacacctgtgagtttgttgtttgaaatgtcaagtacattcaaagatggtaggctccgaaaaccttttccaatatttc

SEQ ID NO: 248 - DNA, 129 bp, Arabidopsis thaliana
ttgtttgttgttgttgcaagaatattttagatgcaaattctttttccatagatgtttttgtgttttcttcagtcaaatatatggagaaatttcatactttgttattgctcgtgactgctatattcaagt

SEQ ID NO: 249 - DNA, 107 bp, Arabidopsis thaliana
aactcagcctcaatatgatgacattagcactaggtagtttgttgcattgtttctcatggacatcctctacacctcgagaacacattgacatgaccgagaagcctgga

SEQ ID NO: 250 - DNA, 155 bp, Arabidopsis thaliana
ggaagtttcgaggggttggttgttggttttcccgatgacttcggatggagctacgtcgacatcagcagctgcagctgcggcggcggcagcagcggcgaggaggaagccgtcgtggagagaaagggagaataatcggaggagagaaagacggagaa

SEQ ID NO: 251 - DNA, 99 bp, Arabidopsis thaliana
taccatagcggggatatctggagtcgatttcttttgttgatcaggaatgtttacagtttccttggcattagaaccatcatgaatgatatcagtcttggg

SEQ ID NO: 252 - DNA, 66 bp, Arabidopsis thaliana
actctatagtctctggtcttcttcttcagtctcaacgaagcttaaggggaagaaaggagatatatc

SEQ ID NO: 253 - DNA, 83 bp, Arabidopsis thaliana
ttaccaccatgacgcgctagtttcatgttctgtatcaataaaagaatggttcttgtaatggtgaatgtgtgtgtgtatgtgtg

SEQ ID NO: 254 - DNA, 128 bp, Arabidopsis thaliana
gtcaagttctggtgctccttcacgcaaggttctctctctcacttgctctgtttatttaactttggttttggaattagggtttttgactatattttgggaaactgtgtgtgtatgtagactctgagtaa

SEQ ID NO: 255 - DNA, 113 bp, Arabidopsis thaliana
agagccaatggcttcttcaggtttcagcggcgatgaaactgcgcctttcttcggattcctcggcgccgccgctgcgctcgttttctcctgtaagatttcagatccctctcttg

SEQ ID NO: 256 - DNA, 88 bp, Arabidopsis thaliana
cgtgatggattattatgttgatggctcattgacattgctgcagcagcagtcatgagacgatgttgttgttgagatacattgtggttgt

SEQ ID NO: 257 - DNA, 141 bp, Arabidopsis thaliana
tcgactgcatggtgtttccatttgttggtctgtactgagcagcccatagccttttttgaagctgttgttgctgctgctggtttgcgttgtaagcggtctggaaccgactggctagataaggagaaagctgctgcacctaca

SEQ ID NO: 258 - DNA, 192 bp, Arabidopsis thaliana
atcacgaggacttacatggcctcaagtcacctgtggtgttgtgcaagaaggagaagcaaagtctgtctatgtattatgagatagctacttctatggctaggatatatgttgtacaagaccggcttttcttctacttcttgcacaacctgaggttattgaggctatacaagtcttcttctataatgttattta

SEQ ID NO: 259 - DNA, 238 bp, Arabidopsis thaliana
agtgatttgtttttggatctttaacctttttgatcatgcgggtttgacaaaagagtctcttacagagatctttggcattctgtccacctcctctctctatatttatgtgtaataagtgtacgtatctacggtgtgtttcgtaagaggaggtgggcatactgccaatagagatctgttagggtttctttgtaaaacccctcatgatttgatatataaagatagtgatcaatatcattcg

SEQ ID NO: 260 - DNA, 91 bp, Arabidopsis thaliana
atatctggcgtggtctctctctctctaactctaagacacagatttaagtgtagagtttatgtagagaagagtcggcacgtattaaaaagag

SEQ ID NO: 261 - DNA, 119 bp, Arabidopsis thaliana
aaaaagaagaagacaaccatcaggtctcattaatcaacaactcttcatcatcatcatcagtgttattcattttggcagtgactttgtgtgtgtttgacaggttgggaggtgggaagaag

SEQ ID NO: 262 - DNA, 109 bp, Arabidopsis thaliana
aagactcttatttctgtgtccttcaaatgttgttgttgcaggttttgatggagttgagattcatggagctcatggctatctgattgatcagttcatgaaggacaaagtg

SEQ ID NO: 263 - DNA, 81 bp, Arabidopsis thaliana
tgctgctactgtagcaggaggtgcggcacaaccaggccagctggcgttccaccagatccatcagcagcagcagcagcaaca

SEQ ID NO: 264 - DNA, 61 bp, Arabidopsis thaliana
cttccagggcatacgagatgctgctgttgagctgttgcacactcttgtagctgtccatgca

SEQ ID NO: 265 - DNA, 123 bp, Arabidopsis thaliana
atgaccctgcggtacagagatctcttcacttgattacgcttggaagccgtgatgatcatgataatgatgaacatgggaaacaccaaaacgaagatcttgatgatgatgatgactatgaggaag

SEQ ID NO: 266 - DNA, 91 bp, Arabidopsis thaliana
taaagtgtatcctttgagtgttctgttgttgctgacggtaattattgttcggctgatgatttgatggttttggaacatatttgaccttgga

SEQ ID NO: 267 - DNA, 119 bp, Arabidopsis thaliana
aaggtgatcactagtaactgcaaatagaaacgaatcaaactattatgatgatgatcctgatgctgccatctgacattgtgaatgattttgcatgtcctgttctgtttgtggcgttagat

SEQ ID NO: 268 - DNA, 61 bp, Arabidopsis thaliana
tgaggttgttgatgatgcttcaacggatgcaatcatatcgtggagcgaaagcaacaacagt

SEQ ID NO: 269 - DNA, 113 bp, Arabidopsis thaliana
atctgatgttgctgatttggaatttggtttcagctttatagattggtgataaagttttgatttttttttgttgttgttgcagaaactggattttaagtttccactatcggttt

SEQ ID NO: 270 - DNA, 67 bp, Arabidopsis thaliana
catttccctttttgtgatgtgatgctaatttgcccatgatggattcagatcgggatcactcacattc

SEQ ID NO: 271 - DNA, 137 bp, Arabidopsis thaliana
ttttttttatctttgtgggttattgaagtgtgtgatagggaactaagttgcattcagctctctctctagatatatattaacttttttggtcatatatatccataacttatacttaaaattagaaagaaagtaagtat

SEQ ID NO: 272 - DNA, 89 bp, Arabidopsis thaliana
ctctttatcatatataaatcctctgtgttgctcagctcttgtctttagcagtcgtgtctgcaactgcaaacagtagttccacagtggct

SEQ ID NO: 273 - DNA, 128 bp, Arabidopsis thaliana
aggatttaaacgttgcactacgtgacattgaaactgtctttcaacattccaatatttcaactttcgaatacccaatatttggtttgttcaaagacattttcgatgtctagcagtgccaatgtttaaaa

SEQ ID NO: 274 - DNA, 94 bp, Arabidopsis thaliana
ccttttgacgatgacgatgatgatgatgatggattccgcaacgttgagtcactcaacttgagtgtatcgtcccataattgatagtggaagaaga

SEQ ID NO: 275 - DNA, 175 bp, Arabidopsis thaliana
gtactcttacagatggtgatcgtgaaaacaaacggaggagtttgtttgttgtactcggtctagttcaaaccaaaacatctttgcaaatatgtatggtttgagctagaccgatgtcaacaaacaagctgcttcgtttgtattcaccatcaacatctttaagaaacgctgcaccact

SEQ ID NO: 276 - DNA, 66 bp, Arabidopsis thaliana
aacaattcttctacaactccaacagcagaaagcttgttgccatttttgttgttggtatccatatgg

SEQ ID NO: 277 - DNA, 84 bp, Arabidopsis thaliana
cgtgctccaatgttttacatgcatgttcttgttgactttctaaaaggtttgatacaaaatgtggaggctgaagatcggggctaa

SEQ ID NO: 278 - DNA, 91 bp, Arabidopsis thaliana
tctctctgtttcatggtgtgtgtgtgtgactaattcacttgttgtccaggtcgagtctattctcagatgatactcaccacaaaaaaagaaa

SEQ ID NO: 279 - DNA, 85 bp, Arabidopsis thaliana
aatctccagaaaggaagattccgtttagagagaaagtcatatacactgtgatctctctcttcatcttcttggtttgtagtcaatt

SEQ ID NO: 280 - DNA, 128 bp, Arabidopsis thaliana
tggtcgaactttttgtatagtcatggatcgtccttagaaatttcgtcttctttttttctttctttcctggaattcgtattgaattgacaaaaatttctctgttgatggtgttgctatacctcgatcac

SEQ ID NO: 281 - DNA, 79 bp, Arabidopsis thaliana
ttaggtatagaatatccgcagttatgttcctggcccagccggattttgtactgtgtctgtctgtatttgatgatatata

SEQ ID NO: 282 - DNA, 71 bp, Arabidopsis thaliana
atgtgatgatggtgatcatgatcattgttggtgcttatgtattggtgatgatgatgatgatcttgctcttg

SEQ ID NO: 283 - DNA, 115 bp, Arabidopsis thaliana
gacccaatttaacaaaagtaggtccgagacgagtgaagatccgccggagctcgattgctctcttcttcatgttcttctctaagttgccctgcttctggtcaatccccaatttcaa

SEQ ID NO: 284 - DNA, 76 bp, Arabidopsis thaliana
gattctgctctctttgctcttcttcttcagccttcaggtgactgttgaggagctgagcgagcgagcgagagaatcg

SEQ ID NO: 285 - DNA, 126 bp, Arabidopsis thaliana
aaaatgggtttaagcttgtttgttcgacttcttgagctatggatcattgtgtctatattaatgaatgtgtgtctaaagtcttagtgtggttcttgtttcagctctgattttgtattatgagtaaag

SEQ ID NO: 286 - DNA, 81 bp, Arabidopsis thaliana
ataaacttgatgactttggtgtttgtgtatgatagggtaaaggctctgcaacaaaaatccgcaagcaccactggttactag

SEQ ID NO: 287 - DNA, 77 bp, Arabidopsis thaliana
aggcggaggccgcggctgctggcgacggagctgtcttcggcgaaggcgattccgcagctgttgtagcctcgccgaag

SEQ ID NO: 288 - DNA, 72 bp, Arabidopsis thaliana
ggattgtctggttagcgacacggtcggggtaagtgatgttagacatcttgatcatgttgttgaaatgatcga

SEQ ID NO: 289 - DNA, 109 bp, Arabidopsis thaliana
ttatttgtaatatacataaagtttttaactcttctgtatataaatgtatgcacaaaatatctaacgatgtgtataagttttgtatagattggagtttcatttgtttgaa

SEQ ID NO: 290 - DNA, 85 bp, Arabidopsis thaliana
aaacagttcagggattatgttcttgatgttgcttgcattaaccttattgacgagcccattaatacttttacggagagcatcccat

SEQ ID NO: 291 - DNA, 108 bp, Arabidopsis thaliana
agactcaaattgttcaaagcagatcttttggaagaatcttcttttgatcaagctatcgatggttgtgatgctgtcttccacactgcttctccagttctattcactgtc

SEQ ID NO: 292 - DNA, 125 bp, Arabidopsis thaliana
tcaaaaaaaattaacataattttttgacaaatatctaataacccacaaattatgataacttggatatatatatatatctgaagagattattttgaggtttcgacaaggatattttttaaaactga

SEQ ID NO: 293 - DNA, 88 bp, Arabidopsis thaliana
cttaaatttcgaagcagacaatgaggcctaaagcaaatcaaaaccacaagctgaaggttctccttgtttttcttcttgccaccttaat

SEQ ID NO: 294 - DNA, 123 bp, Arabidopsis thaliana
gacttgtggtatgttagttccactgggaatgagatgaagatgcttaggtggtttcttgggattatcatcatcatcatcgtcatcatcatcaacaagaggaaatggaacatgttcagggaaagc

SEQ ID NO: 295 - DNA, 72 bp, Arabidopsis thaliana
aagcctctttttggctatgttcttatactcctacagtggtgaaacacgtataaacagggtgagagagagaga

SEQ ID NO: 296 - DNA, 120 bp, Arabidopsis thaliana
ctacgttactcttattttttctagtttaagacagtgattggatgattgtactactgttttttggtctttgtagatagatattatcacacacatgtgttggcagctaaaaaagagtttggt

SEQ ID NO: 297 - DNA, 109 bp, Arabidopsis thaliana
gagccatacaaacaatttgatgaattgatgatgaagatgaaaatgaaatcactccccgtctcctcttcatcttcttctgaattcgtactgtttggttaccaatgtcgtt

SEQ ID NO: 298 - DNA, 146 bp, Arabidopsis thaliana
cgagagcttgaccagatgtgaagactttggcacagattggacattcatggtgactactagtactcttcttcttcttcttcttcaactcatctgagcctaattgatctgtttctgctatcttcttcttgtggcttgctctgtgtccc

SEQ ID NO: 299 - DNA, 89 bp, Arabidopsis thaliana
ttttcttattcagattatagagattgaagatgatgatgatatggtaatgtattcatcgatcttcaccaattgtgtttctttgtatttac

SEQ ID NO: 300 - DNA, 104 bp, Arabidopsis thaliana
tgatcagctccaagatgcgagggaataccaaaagagctcgaggaaatggacttgttacgccatcatcctcttcatcgtcatctttatcctccttctcattcccc

SEQ ID NO: 301 - DNA, 119 bp, Arabidopsis thaliana
gcgtcgagagtcgtcttcaaaggtgatgggttttcagaggaaacgtcatcttcatcatccgaagaagagtttcgtgcgatttctttaccttcttcgtcgcttgaagaagcactcggcgg

SEQ ID NO: 302 - DNA, 89 bp, Arabidopsis thaliana
ataccaggtacttgaagaaaagggagagagtgttgttgctcctggaacattgctgagaactacacacacatacgttattaagactggta

SEQ ID NO: 303 - DNA, 133 bp, Arabidopsis thaliana
gagaaagttaaaaaggtcttgagtgcaaatgctgaggcacagctgaatattgaatgtctgatggaggagaaggacgtgaggagcttcatcaagagagaagagtttgagcagttgtcagcaggcttgttggaga

SEQ ID NO: 304 - DNA, 131 bp, Arabidopsis thaliana
caagagttaaagacgagattgatagtgcagtacaccaagatgcatttaagtgaggcattcattgttcttgaagtgtacaatttccttaaatgcgctcttcactctttttttatttcaatgatatgttaaat

SEQ ID NO: 305 - DNA, 93 bp, Arabidopsis thaliana
atattttttccttaaaatcctatgtgtgtgtgcatgtgtatatctttgttagataacacgttaagttcggttcatagaataggtaggaaaata

SEQ ID NO: 306 - DNA, 118 bp, Arabidopsis thaliana
tattttgagatatgggcggttgtgtctcggtctcgttgtcatgtgatcgagaagtgaatcagttttcacagtggttatgtgtcagtgggagttatatccaaaacctatctgagaatct

SEQ ID NO: 307 - DNA, 61 bp, Arabidopsis thaliana
taagcagatgcattgaggccatatggcatatgttgttggtgctcgtgctgctgctgctgat

SEQ ID NO: 308 - DNA, 136 bp, Arabidopsis thaliana
ctacaggtcctcatcatcatcatcatcatcatcatatatataggctggttaacttgctgatgcatatatattaatggtgatatatatatgatgcatgcagtacttgttaaaatggaggaaagaagcgatcaataac

SEQ ID NO: 309 - DNA, 75 bp, Arabidopsis thaliana
aaaggaagcttctcagtaactctcttcttcttcctcagaaaatatcggaaaaggaaaaaagttgctctcgcttca

SEQ ID NO: 310 - DNA, 100 bp, Arabidopsis thaliana
cactatgtggaaacagattctgagtaagcttcctaagaagtcttcttctaagaaccattcttcttcatctagttccacttcaaaaagtagtgataatggc

SEQ ID NO: 311 - DNA, 113 bp, Arabidopsis thaliana
ttgttcttcattgatgtggaaagctttgagagagatagagtaagttttgcctcctcttcgtcatcttcttcttcttcagcaatgctctctttgagctctccaagtgaagaacg

SEQ ID NO: 312 - DNA, 86 bp, Arabidopsis thaliana
aaaaagctttgtatatttagggttttggtgtagattttgttttctcatgtgattcttatctgccttttatatatagagagagaaaa

SEQ ID NO: 313 - DNA, 81 bp, Arabidopsis thaliana
ttaggagggcttttaacagctgattttgatgaagattcttgcttgagtaggtatgagtcttccttgtatcgcaagccttca

SEQ ID NO: 314 - DNA, 114 bp, Arabidopsis thaliana
gtgattaatgagtgtgtgtttgctgacattttgagatattgttttttttttttttttcagactgaagtaaactatcttggtcaacttagtcacccaaatcttgtattactagtt

SEQ ID NO: 315 - DNA, 151 bp, Arabidopsis thaliana
tcccaattattaaacaacaaagcaagagagagagagagagagagatagggttttttgaggtgtgtgtatttgtatatttatataaatattttagtgtggcttcttgttcttcatcctctaatattatcatcatcatctatctacttgggtt

SEQ ID NO: 316 - DNA, 138 bp, Arabidopsis thaliana
agaagaagatgagactgcttcgcttgtttcactgagtgatgatgaagcattgcttttccatctttgttgatggttatgaggatgattcaacgacagagacagcgataactcttcttcttcttcgtgttcgttttctcg

SEQ ID NO: 317 - DNA, 80 bp, Arabidopsis thaliana
ccattggatttgtctctgatgatgttggtcttgatgctgacaaatgcaaagtcctagtcaacattgagcaacagagccca

SEQ ID NO: 318 - DNA, 84 bp, Arabidopsis thaliana
atgggtctgctcttcttcttcatcacccgtttattttacttggggtctggagtcatgggtgaataaaggctagagggggcagag

SEQ ID NO: 319 - DNA, 82 bp, Arabidopsis thaliana
gagagaagcggggagagagagaaagagaggccggcgttgggtttagttagggttcttcttcttctacttctagccgcaacaa

SEQ ID NO: 320 - DNA, 110 bp, Arabidopsis thaliana
agaagagtcatatagcatgtagcacacactctggtgataaaaaattatgtgtgtgcatgttgtcagtgtgtgtgagtgtgactgtgtgtcattatatcaataacaaagga

SEQ ID NO: 321 - DNA, 114 bp, Arabidopsis thaliana
gaaccatgatcttgaagttgaagatgaatctctaggtgttgttgttgaatggcactatcatcatctccttcttcttcttcatccagcatcttttcaagatcatccgcatattcc

SEQ ID NO: 322 - DNA, 133 bp, Arabidopsis thaliana
atatgattggatttgttttcaagatttgttttgattattgctttgttaattaaaaaacgtgtgatgatatggaattatgattttgacacaagctggtaatcaaacacatgctctgttacataattataaaaag

SEQ ID NO: 323 - DNA, 96 bp, Arabidopsis thaliana
cctaggagaatgggcgtttaaaatcaaagtaaagcagagtaccagaataaaaatgttttgtgttcatgttgatgattttaatcttattaaggtaga

SEQ ID NO: 324 - DNA, 79 bp, Arabidopsis thaliana
acccattatcgttgtcggagtagcgtgggagccattgtagcatatgatgtctatgctgatgatgatgagcagcagtttc

SEQ ID NO: 325 - DNA, 81 bp, Arabidopsis thaliana
agaagatgacgatgatgaagaagaagaagatgatgatggcgatcgattctaaactttcttttttaccattcttattttcgt

SEQ ID NO: 326 - DNA, 96 bp, Arabidopsis thaliana
aaactacattggctgatcgatctgcgtgaccagcacttgttgcagcagctgccgctgccgctgctatgctgtttattgcaggctgcaaatgtagaa

SEQ ID NO: 327 - DNA, 105 bp, Arabidopsis thaliana
gtaccctttttctttgaaacaaagaatcttttttgctgctgatgatgtttgaatagaatgttgttgatactcaattggttttttgggattaatgcagggtactaa

SEQ ID NO: 328 - DNA, 125 bp, Arabidopsis thaliana
cagaattcaaaatgagtgagctttttgttgtgtttagttttcacataatcgtgtgaattgttgttgtgatgctactagctagtttcaacgtgtttacgacatgaaaaggttttattttgcttgcc

SEQ ID NO: 329 - DNA, 73 bp, Arabidopsis thaliana
atagtattgagatgtgaagactcatccaatgttgatgccataccggtttgagtcatcatcatcatcatcacca

SEQ ID NO: 330 - DNA, 70 bp, Arabidopsis thaliana
gatcattgatccataattatttgttgatgatgcagtttactcttcatagaatcagcggatagacctggac

SEQ ID NO: 331 - DNA, 97 bp, Arabidopsis thaliana
cggcggcttcatcttcatcatcatcaggaatctcgggatatggatcagccatgtccttatatgatgatgatattgatgaggaagaagatgaatgtta

SEQ ID NO: 332 - DNA, 83 bp, Arabidopsis thaliana
tcccgcaagagcttacagcaaatgagaggatccgaattcagttaaagcgtggtttagatatgttgatggaagctgttgaagga

SEQ ID NO: 333 - DNA, 88 bp, Arabidopsis thaliana
tcggttggccttggaagaatgttgttttcctacgcttttcctcccttgcgtgttgatttgtggcgtaatatcattctgagagataccc

SEQ ID NO: 334 - DNA, 91 bp, Arabidopsis thaliana
attgatgtaactgaggagaggacagttgttgttgttgctgctgctgctgctgtaagagaagagcctgtctttgactcggttggagtcggaa

SEQ ID NO: 335 - DNA, 87 bp, Arabidopsis thaliana
cttggagagttagtgttctctgcagtattttctgcagtttcatgttcctcttcttcttttgcttcatattctgtttcattctctacc

SEQ ID NO: 336 - DNA, 121 bp, Arabidopsis thaliana
gttggtttcatcgtaaccaagtctcccatgtttgattcaaaaatgttttcttctcttgatttaagaaaccgctctgataccaaatatagatttcaatgaagagattaagaacacaaaatca

SEQ ID NO: 337 - DNA, 106 bp, Arabidopsis thaliana
gttgctgctaaaacaaaaaagtgaatgtctacttcttattcttttttgttggctggaagagagttggatgtgttcttgagtttcagcggtaagatagctcttgacg

SEQ ID NO: 338 - DNA, 79 bp, Arabidopsis thaliana
tctttgtggatgtaattgactgttcccgtttactattatgtagtagattgtatattgttacgtttacagaccttttttt

SEQ ID NO: 339 - DNA, 90 bp, Arabidopsis thaliana
ataacacttacgctgcagttggagcaggtgtagcagcaggtgctggagcagctacaggcgcaacatctccaccgggaccctacaagcaaa

SEQ ID NO: 340 - DNA, 116 bp, Arabidopsis thaliana
ttaggtttcagtttacatgttgtcttggtatgacatataagaatgttcttggattttggatcttagctattcatagtgttttggaaaagagaaaaaaaaaaacaaaggaatcttgg

SEQ ID NO: 341 - DNA, 69 bp, Arabidopsis thaliana
attcctccactttagaactttctgctgcagctgctgctgcagttatggcgacagctgcagcagtgagca

SEQ ID NO: 342 - DNA, 128 bp, Arabidopsis thaliana
aaaatgatataataggtgtttgcaacagcttctacaacttggacatattgctacctcttgtgcttgttgtttagctcgttcttcgactattttctctaaactcaatttctcaccctcaagtcttgcta

SEQ ID NO: 343 - DNA, 105 bp, Arabidopsis thaliana
atcaaaagatgtcccaagcagcatttgaaaaatgtgtgcatgcatatttgcttttacaagcacgtagcatccataaaaatcatggtcaggattgttagagactca

SEQ ID NO: 344 - DNA, 88 bp, Arabidopsis thaliana
acgacgctgtcatgtacgagagtagtcacatacttgatcatctcttttgacttaatatagtgtgactgtgtgagtgcatgcatgttgt

SEQ ID NO: 345 - DNA, 123 bp, Arabidopsis thaliana
atgttacagtttggagttgtgtcctgagctagagaatgtctgtcccggagttgtgtcctctgcttctttgtggactgtatcctacagagacaaattgcatttaagactttgataactgcaatg

SEQ ID NO: 346 - DNA, 107 bp, Arabidopsis thaliana
aggtgtcatattattcatattcaacggttgatttattggagttgtttggctctagttgggtatttatgtgtatgtatatcagacaaaacataataataggtatactt

SEQ ID NO: 347 - DNA, 79 bp, Arabidopsis thaliana
tgtatcatttgtgtgtttggtcattggtgtgtatattgtaaatagaagcaacactaatgatgatgctgcatggtacact

SEQ ID NO: 348 - DNA, 208 bp, Arabidopsis thaliana
ttttttttttttgataaatacttttgtttgcttacaagtataaagccatcatgtttttttcatcagtttcttgttcgtttcaaaattatgatttttgtttacttacactcataatcttgaaacgaacaaaaaactgatggaaaaacatgaggactttatacttgtaaataaataaaaatatttattagaaataaataaacaaaaatat

SEQ ID NO: 349 - DNA, 76 bp, Arabidopsis thaliana
agagtagcactagtgtcgttgatcaggtccggtcgccagctgatgatgctggtgtcacttcttcatccaccatatg

SEQ ID NO: 350 - DNA, 82 bp, Arabidopsis thaliana
agttaagacacgtgatgttgttgtaaagagggatgatggaaattagaaaatgaggcaacacatgtgctcttcaacctacgaa

SEQ ID NO: 351 - DNA, 138 bp, Arabidopsis thaliana
aagaggagctatgaacttgttttgcttcaggtatgattgacttcaaaaaataccttgaaactataaacctcagtttctttgaatttgatttttaaagtcaataataccttgaagcaaagctcgcgttcatcaccgcca

SEQ ID NO: 352 - DNA, 78 bp, Arabidopsis thaliana
gatgggagagctggttaaatacgaagaggattttgaaagcttcttgcttgaagattctgcatcttactactctcgcaa

SEQ ID NO: 353 - DNA, 84 bp, Arabidopsis thaliana
agaacagaaaaagaagagaggaagggtgacgtggcacaatttccctgcgacgcacccaacctccgtctctctctctctcagatc

SEQ ID NO: 354 - DNA, 95 bp, Arabidopsis thaliana
aaagtctcttactttggtgttagttgttgttgctgtatgtgagattacgattatatgatagtcgcagctcctgatattgttgtaagtttttgtat

SEQ ID NO: 355 - DNA, 124 bp, Arabidopsis thaliana
ccgacactaatctcattttacctgtagaagcaaaggatagttgatttcttcagtagtatgtgtagttggttgagagcattagatgatccagctttatgagcattaagtggaggaaccacatagt

SEQ ID NO: 356 - DNA, 88 bp, Arabidopsis thaliana
tgtaaacaggtattttctgtgatctctcatcttcttgtctctcagggaagatgagagatcacagaaagaaagcgaccaatgaaaattc

SEQ ID NO: 357 - DNA, 89 bp, Arabidopsis thaliana
aggacatcaaattttacacattttggtttgattttgtagcgtgtgaagaaaaacagagaaccgagatgggatgaagattttcagttccc

SEQ ID NO: 358 - DNA, 90 bp, Arabidopsis thaliana
aaattgaagttgaagatttcgctttaatgtgtgtgtacatataccatggtatgtcatgaaataaggaagtctttttttagtaaaacagca

SEQ ID NO: 359 - DNA, 235 bp, Arabidopsis thaliana
taaaatagattggatctttaaacttttgttccttttcatgagggtttgacaaagattttcttacagtcatctttggcattctgtccacctccttctatacatatatgcatgtgtatatatatatgcgtttcgtgtgaaagaaggaggtgggtatactgccaatagagatctgttagggcttcttcgtaaaaccctcttgatctatatacaagtttatcaatgtcttgaatttgac

SEQ ID NO: 360 - DNA, 81 bp, Arabidopsis thaliana
cggcgaactggaagaagctttgcttgtttttcttcacattctcgaagaatccagaagcaacagcggttaaagccttcgccg

SEQ ID NO: 361 - DNA, 90 bp, Arabidopsis thaliana
attgttttattaaaacgtattttcccgttgttcattatcagtgtttaatcttgatgatgatgggttcatcttgtttgaaaataatgtttg

SEQ ID NO: 362 - DNA, 116 bp, Arabidopsis thaliana
gctatcatttcagaaaagacaccaatcactgaagaacaggctgctgctgctgggctcttagctgaattgccagatagggatttgggtcttactcaggaaatgttagaagttggtgc

SEQ ID NO: 363 - DNA, 103 bp, Arabidopsis thaliana
tggtggtgagatctcacagcagcaggctacttttgctcagatagccgccattgctgctgctgccaaagctgctgctgctgctccagtgagtgctcctgtgaca

SEQ ID NO: 364 - DNA, 128 bp, Arabidopsis thaliana
agaagcttctttcctttctgtttttttcaaattagagttttctggatacttattagttactaacaaagagagggcttcttcgatattaacttttaagtatccagaaaactctaaatttgaaacaaact

SEQ ID NO: 365 - DNA, 96 bp, Arabidopsis thaliana
agtgtaccaaacattgcattcaggaaatgtatggattggtggtttaagatcatcaatcattgtgtatctgtgtgtgtatataaatccctttggtat

SEQ ID NO: 366 - DNA, 147 bp, Arabidopsis thaliana
ttaactggaggaggaggagatttgtacacgtagtgtttctttggtggtggtggggaatggtaaaccggaggaggagagtagtgcttaaccggaggaggaggagatttgtacacgtagtgtttctttgggggtggtggggaatggtaa

SEQ ID NO: 367 - DNA, 101 bp, Arabidopsis thaliana
ttttgtttacatgtttttgctgaatctgttttctgatgttgattcttcagcacgcaacttcctcaagctgctggagttggttattctttgaaaatggacaa

SEQ ID NO: 368 - DNA, 95 bp, Arabidopsis thaliana
aggagacagttgaggagagtcattggataagggataccagagaattgttcagtggatttgttcttgatgattctcttgaatgttatcctaatttc

SEQ ID NO: 369 - DNA, 91 bp, Arabidopsis thaliana
aaagatttatgatgtcagagaagaaatcagcagtttcttcaggcaagctgatcgagaactgatgctggagatgtttcaagaggttttgtct

SEQ ID NO: 370 - DNA, 82 bp, Arabidopsis thaliana
agtgattgtgattgttgtacaagttgctgaggtaattgagatggtggtgttgctgcaagttagatgactcgaaatcacgaaa

SEQ ID NO: 371 - DNA, 134 bp, Arabidopsis thaliana
tatatagagattccaaggtgtgtgtatgtatgtattttatgtatatgtatgcgtatgcgtatgcatgtatgtattgagtgtaaaatgtgtgtagatcaaagaagagtgaaaagaagaagaagaagaagaagaag

SEQ ID NO: 372 - DNA, 78 bp, Arabidopsis thaliana
acaaaccgaaggaatttacggacttcgtgacttgaagagcgatgtcattttcagtcttgagttgctgcagaatcctta

SEQ ID NO: 373 - DNA, 129 bp, Arabidopsis thaliana
gttactcagcttctattgaaagttcgaattttaatctgattgagatatgtagtatgatggatgtgtttgatactattaactgtacatcagattagattagtcgagttatgtcttttggagacggctttc

SEQ ID NO: 374 - DNA, 90 bp, Arabidopsis thaliana
gtggagatatagttgtgatacgatctccagagaaccctaataagactccgattaagagagttgttggtgttgaaggtgattgtataagct

SEQ ID NO: 375 - DNA, 79 bp, Arabidopsis thaliana
aaacagggcagctcatgtctcgtgacttctttcttgtcgtacaagcgacaggtacatgaggaatgtttctgctgtgtcc

SEQ ID NO: 376 - DNA, 103 bp, Arabidopsis thaliana
ggtgaagctggcggtgaatttgtaggatctgatgctggtggagctggaggagattgtaacggtggtgattccgggtttgtgggtcctacattcggcgacggcg

SEQ ID NO: 377 - DNA, 72 bp, Arabidopsis thaliana
aagactcggactcggtcttcttcgtcgtcgtcgtctacggcggcggaggagaatgataagaaggtaataaca

SEQ ID NO: 378 - DNA, 85 bp, Arabidopsis thaliana
aacaagtccaaacatgatgcgtatcaggaggtaggcttcttggtaggatactttgtgttgtgtgttgcactttcttagttctttg

SEQ ID NO: 379 - DNA, 88 bp, Arabidopsis thaliana
ttcacagtccatttccatcatcagaaatttaccgtactttgccagtccgggatgatcttttgagaggattgttgaactgtgatctcat

SEQ ID NO: 380 - DNA, 93 bp, Arabidopsis thaliana
acggctaagtctgaagaagaagaagaagaagatgatgatgagatttaccaagttggtttggtgtttgatgttcctgcttcgattcggcttctt

SEQ ID NO: 381 - DNA, 76 bp, Arabidopsis thaliana
tacggaaggaaagctacgattagggagttttacggtaagactaagctcttaattgtgattgtgtttcttctactgt

SEQ ID NO: 382 - DNA, 107 bp, Arabidopsis thaliana
aactacaaaacgaaaaagaaaaatatcgttggtcattgttgttgttgctagcagctataaaacgtacgtgaccaatgatattttccgttgttttaccatcggatgag

SEQ ID NO: 383 - DNA, 128 bp, Arabidopsis thaliana
ttaccacaagtgcttttataagcttttgcatctgtttatgctaacactggtgtgcgttttatatatgcatttgcatgcatacatgttttttacaaacatgtgaagggttgtggaaaatttgttttgtt

SEQ ID NO: 384 - DNA, 75 bp, Arabidopsis thaliana
aggatatgtaccttgagctcattctttgacctgataggttcttttgtttgcaaaccaaggtcatcatcctcatca

SEQ ID NO: 385 - DNA, 90 bp, Arabidopsis thaliana
aaaaacgatgagagaagagagtgaggcaaagaagttttgtcagagcggttcttcttcttcttcgtcttcttcctttttattggataagca

SEQ ID NO: 386 - DNA, 107 bp, Arabidopsis thaliana
tgtactctgcttctttctgtctcacagctcaatagtttctgtttcgattaaattttggaatgttgtgcaaagttttaatctttgaggtgaaagagatgaagcaaatt

SEQ ID NO: 387 - DNA, 133 bp, Arabidopsis thaliana
gagatggggtttggagtttatatatatacacaaggaagtgcatgtacgttgttgatattatttgttttgttttgtcaaaattgaataggataataagagataaatgtaaaatgtgggtaatgtatgtgtattt

SEQ ID NO: 388 - DNA, 91 bp, Arabidopsis thaliana
tttttccacatattctcttcacaaacttcttcatcttcttggcaagtttacgagggatcttgaagaagatgaagacactgacttgtaagac

SEQ ID NO: 389 - DNA, 123 bp, Arabidopsis thaliana
ttgtcctatttcgctccatggtgagtttaatggtggatgatttgctgaagcgttttattcgattcctttggttttgtatttggttctcattgaattcatataggactgatattgataaagatt

SEQ ID NO: 390 - DNA, 138 bp, Arabidopsis thaliana
ctttctttcttgttggtctctcttacttctttcttattcatctaaaacaatttcgatccatttacacataaatatatgtaactggccgtagaagaaacacattgaaggaagagatggctcataggagattaatcatga

SEQ ID NO: 391 - DNA, 85 bp, Arabidopsis thaliana
gtcgaatttctctaagcttgtgttacatttgttgttgttgcggacaggcaagttcgatatggttgtacatagtgcctagagggat

SEQ ID NO: 392 - DNA, 77 bp, Arabidopsis thaliana
ggactctctgttcttctatcgttacttatttcaaacagaaaaatattagataaggttgtggaaggatatagagtgaa

SEQ ID NO: 393 - DNA, 110 bp, Arabidopsis thaliana
ataaaagcaaactatgagatgatcatctctgctagtataaatatatttttgtcgtatctaaaagcgaagaagaagattctgcaaatagagaaactgcatcttaatcgaat

SEQ ID NO: 394 - DNA, 76 bp, Arabidopsis thaliana
aaagggtcagaaacatgaactgaacgtgtcgactttccagatgtgtgttctcatgttgttcaacaattctgatcga

SEQ ID NO: 395 - DNA, 105 bp, Arabidopsis thaliana
aaatgtccccatgagttccctttaacgcttcattgttaaatactcaaagccacattggtttgtatacaacactgaagtgtttggggggactcttggtgtcattct

SEQ ID NO: 396 - DNA, 117 bp, Arabidopsis thaliana
gtcaaatgtccacatgagttccctttaacgcttcattgttgaatactcaaagccacattggtttgtatataacactgaagtgtttggggggactcttggtgtcattctggcgttgaa

SEQ ID NO: 397 - DNA, 115 bp, Arabidopsis thaliana
aggcataaacagagagaaagtagatgacatgattgatctggtggtgaaaaaggttgtagctgctgtgaggaatagaccagagatagttgcagactacactgttggtctggaatca

SEQ ID NO: 398 - DNA, 95 bp, Arabidopsis thaliana
gtctattgaagagctaccttcgtgtgtaggatatttgacatcgctcgaagatttatatcttgatgatactgcattgcgaaaccttcctagttcta

SEQ ID NO: 399 - DNA, 82 bp, Arabidopsis thaliana
attattagttctttctctgctgctgctaaactagctacttaaaaatttgtagagtggagcatgggaaagtcgagctagcgca

SEQ ID NO: 400 - DNA, 101 bp, Arabidopsis thaliana
acaataagcagttgatcttccacttgtaagtagttttatgttcatgattggctgtcctacttgcactttcagtgtgtcttgaatcaaattagcttgtaaat

SEQ ID NO: 401 - DNA, 120 bp, Arabidopsis thaliana
atcacacatagatcacttccggagttagtcacaaagcaactttttttctactatgagaatgtctttctcacacctaaaagcgtttgaaaaactatctcaggatacttgtttgatatccca

SEQ ID NO: 402 - DNA, 86 bp, Arabidopsis thaliana
tctttgttttctttttgatgtgcttttgcttgattttgatgcaatactgatatttttggatttgaaggagctcaactagagagcaa

SEQ ID NO: 403 - DNA, 99 bp, Arabidopsis thaliana
gtacgtacatattcgcttaagaagttagttaaactatgtttcaggatagaggaaatgttgttgttggtaagactgtctgcttaggttcaatgtctggga

SEQ ID NO: 404 - DNA, 124 bp, Arabidopsis thaliana
cattagcattacaacggattggtgacacaaaataattggttctaggtttatgtttatgctcttttgtttgctcatttagttgatgttatcaaataattggttctaggtacgtgctttcatttaa

SEQ ID NO: 405 - DNA, 141 bp, Arabidopsis thaliana
aaaaaaaataaacatactgtgtggtaaaattggaatgtgatgttggtgatgagagtgaccatgaagaagaagaagaagacggacgccaactcttaagctgaatctggtaatcttactggcaagttagctttcctgtgaccc

SEQ ID NO: 406 - DNA, 87 bp, Arabidopsis thaliana
ccggagtttcacagtggtggtacaaccgcggtgattccgatgccgtcattgtcattgttcttgatgtcaccaacagagaaaaccagc

SEQ ID NO: 407 - DNA, 83 bp, Arabidopsis thaliana
ctacaggtcagtgcatctttcgacctattccttttaaaggaatgagaaaggttcgaaagcatgttgatgatgatgaaggttgg

SEQ ID NO: 408 - DNA, 102 bp, Arabidopsis thaliana
acttcacccaacctcctctccgtggtagaatcttggctccgttctgaaatcaaactcgtgaagaagaagaagaagcctgtggcgccatggaaaccatctcca

SEQ ID NO: 409 - DNA, 102 bp, Arabidopsis thaliana
ttttggagaagagagagtttagggcttttgcgtagggttttgcgtaagggagggatctgatgcagctgcacctacaggaagctctgtgaaactgttgcttgc

SEQ ID NO: 410 - DNA, 84 bp, Arabidopsis thaliana
tgtgatattgatggtgaatcaagatgatgatgttggttactacactgtccctacatgattcacctcttattggtgttaagttta

SEQ ID NO: 411 - DNA, 97 bp, Arabidopsis thaliana
gtcagtgcctgcagcagctgaagtcttcggagcaattgttgagggactattgtggtgccgtgcatctgcatctgtgtgggactgttgagggactgtt

SEQ ID NO: 412 - DNA, 111 bp, Arabidopsis thaliana
tgaagatactggaatgtgtacttatgaagctgagtctcctgatgaagttgctttccttgttgcttctagggagtttggttttgaatttactaagagaactcaatctagtgt

SEQ ID NO: 413 - DNA, 84 bp, Arabidopsis thaliana
tataatctaaatgttgttgttggatctttcttgatgcagcaattattgaaattgcaagttaggtctaatgtcacgcgtggaata

SEQ ID NO: 414 - DNA, 133 bp, Arabidopsis thaliana
gtaaattacggaatattcagtaggtatgtgttatgtgtatgtgtacgtggaaaccatattttgttgttttatggtgaaatatattttatggttgcaactttctaaattatgtataaacaactattggaaattc

SEQ ID NO: 415 - DNA, 133 bp, Arabidopsis thaliana; identical to SEQ ID NO: 414

SEQ ID NO: 416 - DNA, 123 bp, Arabidopsis thaliana
ctaagattgtttgggctttgttatgttctgttgtttatgttagagaagacatgttgttgtttgcctttttaagtgggattaagtaaatgtgaatgatgaacgtgacgcgcttgttccacggtg

SEQ ID NO: 417 - DNA, 81 bp, Arabidopsis thaliana
aagtttcctcgtcgacgacttcttcatcgtcatcgtcatctccagatgaagaaagcgatctccagaatctcctcgaggaat

SEQ ID NO: 418 - DNA, 116 bp, Arabidopsis thaliana
catggaaaaattaaagaatgagattgagccaaggatgacttgccgatgttatcaacaaatcttaactgattttggtgtccggcaagttgaccttggctctgtttccttcttttctt

SEQ ID NO: 419 - DNA, 110 bp, Arabidopsis thaliana
aaatcttgttccttgttgaccaatccaagtgaagcctctgtttctctgtgcctgttgttacccacaagtgacttcaggttaaagatcaagcacttcaatctatcttttcc

SEQ ID NO: 420 - DNA, 100 bp, Arabidopsis thaliana
tcttttagggatggtaatagcaatagtgacaatgatgcagacaatgatgccaatttggagtcatcttcttcatcatcactcacttgttgtgatctcatga

SEQ ID NO: 421 - DNA, 67 bp, Arabidopsis thaliana
ttagatgacagaagagagagagcagacagcttctctatctaatctgtggtcgcttgaatgatgagtt

SEQ ID NO: 422 - DNA, 76 bp, Arabidopsis thaliana
aaacttttgttttaagagacaactcatgtacatgcactttgatgatttcaaagagcacttgtgctgttttgtttca

SEQ ID NO: 423 - DNA, 108 bp, Arabidopsis thaliana
caatagtacagcatctagacatcatcatcatcttcatcatattcatctagataatgatcatcatcgtcatgatatgatgattgatgatgatcgattccgtcatgttcc

SEQ ID NO: 424 - DNA, 121 bp, Arabidopsis thaliana
aacattttagaatcctcaactatcattgtccgatatttaaacattcaactttgcttggtttatatatgttagtgaatgtttgtataagtatgcggagtttgcagccgagcttgatcaaatg

SEQ ID NO: 425 - DNA, 119 bp, Arabidopsis thaliana
acctctttcagcttcttgcaaatcttcttctccatcttgtggctcgacgatatcaaaccagaagaagaagacgaagaagacatcaagaaatactcctcagcttctttaataacagtgtc

SEQ ID NO: 426 - DNA, 131 bp, Arabidopsis thaliana
tataatacgaatcctaaaactatagtgctttgtgtggttgtaaaataaaatggagttcttattcatgcattataccaaaaaacaaaatgtgagggactttatacctaagcaagtggggagttatgaaagta

SEQ ID NO: 427 - DNA, 84 bp, Arabidopsis thaliana
ttggatctttgatgtactacaagaagtgtttggtgaaagcaaaacaagctttatctgttactttcccagatatcacggattctg

SEQ ID NO: 428 - DNA, 101 bp, Arabidopsis thaliana
ccaacaagcttggatctttgatgtactacaagaagtgtttggtgaaagcaaaactagctttatctgttactttccaggatatcacggatcctgttgttcgg

SEQ ID NO: 429 - DNA, 97 bp, Arabidopsis thaliana
cagagctgcgcaaaagctgaagcaaagagagagagagagtctgcttcttcttctgcttcagcttcagcttcttaattattaatcttccacttgtttc

SEQ ID NO: 430 - DNA, 75 bp, Arabidopsis thaliana
taattacttgcttttaatctcttgtgttcttgatgtgacaggcttttgggtaaagtggcattgatcactggagga

SEQ ID NO: 431 - DNA, 86 bp, Arabidopsis thaliana
gattggcatacttacatgaagattgtgagtataatgttcttgtctttgagtattgtacaacattagtttctgaagtttttgtcaag

SEQ ID NO: 432 - DNA, 127 bp, Arabidopsis thaliana
tcaattctatttataagtcataaatacatcattatcatctatatataactacttggttaattttgtttgttctataatgaattttcaggagtttgatgagagatatgggagtggatggcaatgtgtg

SEQ ID NO: 433 - DNA, 127 bp, Arabidopsis thaliana
aattttttacggatatgaagttgttgaaactcatgtgagcatcttgtcacaacctctctcttcttgtacttgctcttcttgtcacaaactcatatgaagttgtcttttcatcgatagaaacttaagc

SEQ ID NO: 434 - DNA, 132 bp, Arabidopsis thaliana
gaagtcgctcttggtcatgtaagtttcccatgagaatgatgtctattagcccttgatccttgtgcttgatctatgtctctatctaaacagaaacttaagtgggaacaatctcagtggtgtagttcctcaaaa

SEQ ID NO: 435 - DNA, 89 bp, Arabidopsis thaliana
gctatattatgatctgtgtgtcctagattgtttattgatgttgatgataaagtcttatctgtttcaattgatgcaggatgatggagatt

SEQ ID NO: 436 - DNA, 125 bp, Arabidopsis thaliana
aattggcaaatgggtcctcgtcgtttgtgaacagaaagttgttactgaattgttgttgctgctgctcatcgccggaagaagaggcaaaaagtgatgaactttcacgaaaaggactagaattgaag

SEQ ID NO: 437 - DNA, 91 bp, Arabidopsis thaliana
gcttcttcttcttcttcgtaattgcttgttggaaccatagacatatgggtttgtgattgtttcaatgttgtgtaggaaggctttgagaatt

SEQ ID NO: 438 - DNA, 86 bp, Arabidopsis thaliana
tttctggaatcagtgcccttgggaagatgatttgaaatatgcaaaacatgtttgtgagcaggtactgttcttgataaaccatttcg

SEQ ID NO: 439 - DNA, 82 bp, Arabidopsis thaliana
catgaatcttgttgtggtttacatagaggtatcatagtctgatatgtgattcgtcttgttgttgctgcagatcaatttatac

SEQ ID NO: 440 - DNA, 68 bp, Arabidopsis thaliana
gtgatattatagaatgatgtgtgtgttaatgtacgatgatatgtgcattggcattttatatgtctaga

SEQ ID NO: 441 - DNA, 137 bp, Arabidopsis thaliana
tagagacaatgtgtggaaaaacggaagaaaaaagagatatggtatagtgctaggcatggattctctttctctctcaatcggtttctattatataattttgatctttcattttcatggatgttgtacattattggccc

SEQ ID NO: 442 - DNA, 137 bp, Arabidopsis thaliana
gaggtctatgctctcggttacaataacaaggacttgtgccataactacaaaatcttgaggtttatagatatatgcttggaagtctatgattttagctctaatttatggaggagtttcttgatgtcgtctctcccgaa

SEQ ID NO: 443 - DNA, 124 bp, Arabidopsis thaliana
gaatgtttattgctgcttccccaaaaatagaaaggtcatgatccaatgtagttgttcataatttatatgaatgtggcaggtattgataaagatggaagagagagaagcagagacaggcaaagag

SEQ ID NO: 444 - DNA, 71 bp, Arabidopsis thaliana
aaagacagccaaaggatcctcattcttggtgccaccaaccgtccctttgatcttgatgatgctgtcattcg

SEQ ID NO: 445 - DNA, 99 bp, Arabidopsis thaliana
atatcaagagattaaatagtaacgtgtatatatatttttgctggtcttgaattctttttaatgtatgtacattttgttgttgttttattgacatttcac

SEQ ID NO: 446 - DNA, 112 bp, Arabidopsis thaliana
taatggaaaattcgaagttttagttcttataggtctggcaatttgtgggttttgatctattgttgttggtttccatcaagtatgcgactttgtttatgatttttggttgttg

SEQ ID NO: 447 - DNA, 106 bp, Arabidopsis thaliana
gagtcagttgttgtttatttggatgatgaggatgcagccacaagaaaagatgctgctttgtgttgttgcagactaattgcaaattctctttctggcatcacacaat

SEQ ID NO: 448 - DNA, 92 bp, Arabidopsis thaliana
gacacgtggagtgtttgtgagcttgaccaccaggagaaaccgaacaagtacggtaaattctggtgctggtgtttctggtcacttgacgttga

SEQ ID NO: 449 - DNA, 77 bp, Arabidopsis thaliana
gatctgagaggaatacgatgttgagcccaaggttagcgaaagaggaagctgctcatcgtcatcgtcatcatcatgag

SEQ ID NO: 450 - DNA, 142 bp, Arabidopsis thaliana
tgattcgtcatggttttttggggaagcgaaacgagtctgaatagcgaacgaggaagctgctcatcgtcatcgtcatcatcatgagactgattcgtcatggctttttgggggaaatgaaacgacggaaaggaataagacaaag

SEQ ID NO: 451 - DNA, 135 bp, Arabidopsis thaliana
atatgtttaagtctgggtagtatttgcaaattttattctgataattcccaagtatctaaatgtctgcatgtatatggttctcttgaggtgaaataacatgagaattggaatatttctggaatactcaagtaagag

SEQ ID NO: 452 - DNA, 113 bp, Arabidopsis thaliana
ataaaaacttagaaatataattgattattctacataaagatcgttatcatcctcatcacaagaaggaggaaaggaccaatatgttttattcattgtttctagttgttacaatc

SEQ ID NO: 453 - DNA, 133 bp, Arabidopsis thaliana
ttggtaagcattggttttgaagctgatagatatggccaatcttctcctgagtttgatgaggaatgtttctggtctgcattgctccccgtaagtttgtcaacgaccttcttgactatgtttttgtaagcattct

SEQ ID NO: 454 - DNA, 95 bp, Arabidopsis thaliana
atgagttgatgaaacttggacacagcttcatcagaagagtcacttgtggttcttgaaagctttgtgtcttgaggcatcattaaataatcaaccca

SEQ ID NO: 455 - DNA, 127 bp, Arabidopsis thaliana
atttgtctgtgatgtctaagtggcaggttcttttgtgctcttttgtatttttatatcctttgttattgtttttgttaagggtaggttgctggagcagcagctgctgctggactttctctagcagaag

SEQ ID NO: 456 - DNA, 102 bp, Arabidopsis thaliana
agatatacggaaagcaattatgcaattgcagttttggtttcagagtaaaccgaaaagaggtattttggatgtaaattgctacgtacgagaaaaaaaaattag

SEQ ID NO: 457 - DNA, 64 bp, Arabidopsis thaliana
aatctgcttctgctgctgttgtagcgcttgatctgataagctctgcacggtttgcacttaagct

SEQ ID NO: 458 - DNA, 140 bp, Arabidopsis thaliana
acttgttcttcatcactatcgtcgtcgcttaaaacttgaatctctggttcttctttgaagttcttatcatcatcatcattaacaccagtcatgtttcttcgaaaagcaaaaagtttaaagattttcccgagaaaagtttt

SEQ ID NO: 459 - DNA, 97 bp, Arabidopsis thaliana
gctttttacatgtctatattttcacttttttctcagacacagaaacacttctttggttgctgaggatgatgaagaagctgatatcaagagcaaacag

SEQ ID NO: 460 - DNA, 89 bp, Arabidopsis thaliana
aagcttaccattttctcgtccacttcttgttcttctttggttaaaaccggttttgggtaagtaggtaagggatcttgaagatggtttgt

SEQ ID NO: 461 - DNA, 127 bp, Arabidopsis thaliana
ctaagtgcaagtgtgcaagtgtgtgtgtgtctcaagtagaagtagtttatgtatgtgtgtccttgtgttgtgtaagagtaaccaagtaattaacaatgtagtctttggaggaaaacgcttttgtgtc

SEQ ID NO: 462 - DNA, 150 bp, Arabidopsis thaliana
atcaatgtatgcatgtatgtatgaatgcatggatgcaaacatgtatggatgcatgaatgcaaacatgtatggatgcatgaatgcaaacgtgcatggatgcatgaatgcaaacgtgtatgtatgtatgaatgcaggcatgtatgtgtatac

SEQ ID NO: 463 - DNA, 129 bp, Arabidopsis thaliana
ctgtttgtactgtatgaaacagtaagacttttgtttatgtttttcttgttaagactttttagttttgaagtatagttttatgaaagaaaagtcaaaatgattcagaaataatgcaaattgtttatacgt

SEQ ID NO: 464 - DNA, 93 bp, Arabidopsis thaliana
ttttgattatttaacatgtttacttctttcattgttgcatgtgcttggaggtttactcgcgacagagggtctaaactggttcgaaagatcaca

SEQ ID NO: 465 - DNA, 96 bp, Arabidopsis thaliana
atctctcttctcttccttaccaatgcaatggcaagatgcgttgaaaataggttaggctatgttgttgttgtagactttgatgagaatgtgaatcac

SEQ ID NO: 466 - DNA, 96 bp, Arabidopsis thaliana
atcacaccttaacttagcacttcttgatgttgaagatgactcaatctccatgggaagcattgagcaaggtgtctctgttgaggattatctaaaagg

SEQ ID NO: 467 - DNA, 88 bp, Arabidopsis thaliana
cccgtgttgctttggacattggctgtggtgtggcgagctttggtgcgtttttgatgcagcgtaacacgacaaccttgtctgtagcacc

SEQ ID NO: 468 - DNA, 128 bp, Arabidopsis thaliana
ttacttttgtgaaattcgttgagagatgtttagggttctggtgttgttatagttctacttctggtttgtgaaagaactccgaattgtgaaatttattgtagcatttcagtttggcaaaaatgacaagt

SEQ ID NO: 469 - DNA, 92 bp, Arabidopsis thaliana
atttcagagtcagctcagagttcttctgatttgcagcagttaactctcctttcagttttgttgtcagttcttgaactcttagcttctcttcc

SEQ ID NO: 470 - DNA, 71 bp, Arabidopsis thaliana
cttcttcttcctctttcgagtttgttagattggagagtttgttaccgattaagagagaggttagagagaga

SEQ ID NO: 471 - DNA, 95 bp, Arabidopsis thaliana
aaagcgtcatggactttgctgggccgaaactggtgtcgatcgacaccaggagtgtgtggatcgacactctctctgaatccggaatccgaaatcgt

SEQ ID NO: 472 - DNA, 85 bp, Arabidopsis thaliana
gttagcttatcttcttcttcctctttcgagattgttagatcggagagtttgttatcaattaagagagaggttagagagagaaagc

SEQ ID NO: 473 - DNA, 122 bp, Arabidopsis thaliana
taggctttggacattgattcttggagttgtattatgacagtatagtagttgggaatttgttggtgtaatgtaattgtaatgctcagacaggttggagaacataccgtagaccagacgagaag

SEQ ID NO: 474 - DNA, 82 bp, Arabidopsis thaliana
tatggtcaaaatgtgtcataatccaatgcatttgactaattataaggtttgttctgaccttgttgttgctgtggaggataca

SEQ ID NO: 475 - DNA, 76 bp, Arabidopsis thaliana
gggttgttggttttgaagttgttgtatcctttgtagccaccctggttgttgttgatgtagctgacttcttccaact

SEQ ID NO: 476 - DNA, 87 bp, Arabidopsis thaliana
gaagcttgtcatcgagtatgcagtcgagtggtggtgatggtgatactcgacttcctggtagagtgatgatcaggtaatggaagtgaa

SEQ ID NO: 477 - DNA, 102 bp, Arabidopsis thaliana
gtgaaagataatggattgtatgaaagactgatgaggatgatgattaacgtgtctacatcagtagatataaatattatatagtctacctaaatttcatggagc

SEQ ID NO: 478 - DNA, 86 bp, Arabidopsis thaliana
ctattataggtgagacataaatttgatgagaactagcttagggttcttcagctccttcttcgtcatcttcttgtatcatgttcaca

SEQ ID NO: 479 - DNA, 139 bp, Arabidopsis thaliana
tcatgatcttcctcatagtcatcatcatcatcaagatcttcgttttggtgtttcccatgttcatcattatcatgatcatcacggcttccaagcgtaatcaagtgaagagatctctgtaccgcagggtcatgaggcaaat

SEQ ID NO: 480 - DNA, 86 bp, Arabidopsis thaliana
cgcctccatttttgcattcaggtcattgtagttgcattccagcttgtggtgcaattcagataacttcttagcaatttccatggagc

SEQ ID NO: 481 - DNA, 138 bp, Arabidopsis thaliana
ctgcggtaggagaggttggggttgttggttttgaagttgttataccctttgtagccactctggttgttgttgatgtagctgacttcttccaactggttaccctccccatcttggacttgatactactactcatcaaca

SEQ ID NO: 482 - DNA, 88 bp, Arabidopsis thaliana
attggtcgagtgaatgatgatggtgatacttgaccatgtttgtagagttattggtcgagtgaatgatgatggtgatactcggccatgt

SEQ ID NO: 483 - DNA, 73 bp, Arabidopsis thaliana
ttgttggttttgaagttgttgtatcctttgtagccaccctggttgttgttgatgtagctgacttcttccaact

SEQ ID NO: 484 - DNA, 181 bp, Arabidopsis thaliana
attttggaacaagagctaaggaaaaggaagataaggacgattttagattcagtaatcagcgaggagtgtcgatcgacacactcttggacgtttttagggtctttatattgtttttagacctagttttcattataaagtctttcatctagttttcattatcaagttttctacaaaaccctgt

SEQ ID NO: 485 - DNA, 119 bp, Arabidopsis thaliana
ctgcggtaggagaggttaggatttttggttttgaagttgttgtatcctttgtagccaccctggttgttgttgttgtagcagacttcttccaactggttaccctccccatcgtgcacatg

SEQ ID NO: 486 - DNA, 162 bp, Arabidopsis thaliana
attttggagcaagagctaaggaaaaggaagctaaggacgattttagattcaggaatcagcgaggagtgtcgatcgacacactcttggacgtttttagggtctttatattgtttttagacctagttttcattataaagtctttcatccagttttcattatcaa

SEQ ID NO: 487 - DNA, 162 bp, Arabidopsis thaliana; identical to SEQ ID NO: 486

SEQ ID NO: 488 - DNA, 71 bp, Arabidopsis thaliana
tctccttcaacttaagtgtttttgtttgcttgagggcaagcaagagataagtttgggggagttgataacac

SEQ ID NO: 489 - DNA, 84 bp, Arabidopsis thaliana
gatcgacccctctgttgtgtcgatctacaccgatcacgtctgcattctgctcctgaaggtgtcgatcgacacctagttggtgtc

SEQ ID NO: 490 - DNA, 101 bp, Arabidopsis thaliana
ttgaggagctttactataggacatggcttcacaggtaatggttttctcttcgattgcaatttctgtgtgcttgtcattgaagggtttctgtacaaatctga

SEQ ID NO: 491 - DNA, 130 bp, Arabidopsis thaliana
tggccatgagtcctttactaatctgcggtcaagaggttcaagtttgtgcgaccttgcaattttggtggttgacataaagcatgggttagagccacaaaccatagaatctctaaatcttttgaggatgagg

SEQ ID NO: 492 - DNA, 134 bp, Arabidopsis thaliana
ttcaagttctttattgggtgtctcatcttctttatcgttgttgaatgtggcatcatctcctttgttgttggatgtgacatcattaatggatacatcagcgggatgagactctttcaaagctttcaaatcattct

SEQ ID NO: 493 - DNA, 134 bp, Arabidopsis thaliana
tacgtcgagtgaagaaccagtgaagcataagtagcagagacagagagagatacgtgagtgtgtgtctgtgtttttcgctttttggctttcttcgctgattccacgaacggcgtgaatcgacttttctccagatc

SEQ ID NO: 494 - DNA, 137 bp, Arabidopsis thaliana
tcaggttttgatatggatacaaggatgtgatggcataacgaagaagaggatataagcacctatatatatacatacgtatgcacacacactttcacgattaggtttttgatattagagaaattgggctgttattgggc

SEQ ID NO: 495 - DNA, 142 bp, Arabidopsis thaliana
ttctctcaggttttgatatggatacatggaggtgacggcataacgaagaaggagatataagcacatatatatatacatacgtatgcacacacactttcacgattaggtttttgatattagagaagttgggctgttattggac

SEQ ID NO: 496 - DNA, 61 bp, Arabidopsis thaliana
tgctgaaggagtaggctccatctttctcttcttagaggaagattgattttcttcttctgca

SEQ ID NO: 497 - DNA, 69 bp, Arabidopsis thaliana
ctgtgaatgaagatgataagggagatcaccatgatcacgaccatgatcatcatcatgatcacaaccatg

SEQ ID NO: 498 - DNA, 77 bp, Arabidopsis thaliana
taggagtatttccaattcttttgatgtttcacaagtcttcgttgattcaacattggctgagttggcactttttaagc

SEQ ID NO: 499 - DNA, 80 bp, Arabidopsis thaliana
tttcaagtagatttcttgccaaagtacgaggatcttgagtcagtgtacttgactctcttcttctacctcatcaagacact

SEQ ID NO: 500 - DNA, 101 bp, Arabidopsis thaliana
taattatataacctatctacactttgatctccgacaattcactttcccaataagaaccaactgagagagagagagcgccggagaagaagaattttagagag

SEQ ID NO: 501 - DNA, 66 bp, Arabidopsis thaliana
gattcaatagagtgtgtgtgtgtttcaacgggagagtttgatagcacacgcataagatttatatat

SEQ ID NO: 502 - DNA, 99 bp, Arabidopsis thaliana
gaagaaagtgttaagaagtggaagacatggttgttgagtgatgctgaggtgatgagagcacttttctgtcacatttcagacaactagtctgcctgcatt

SEQ ID NO: 503 - DNA, 135 bp, Arabidopsis thaliana
tattgtttatatatgtggtatgattcggtttgatacgaatcttttgtgtcaaattatctgtttttttatttgtattacaagaaattaaagataaatgtagtatgatgcagatcggtacgaatctttcatgctaat

SEQ ID NO: 504 - DNA, 94 bp, Arabidopsis thaliana
cgaatgatgatggtagtatgatgatgatgattataatagttattaattattattaatgataattatttagattatagatatttttttatcatct

SEQ ID NO: 505 - DNA, 161 bp, Arabidopsis thaliana
aacctcaaatatatcagagggtgtagatactcaacgactataggaggcaataacttgagcaaacaattgattgcagaaatccatcgactaaagctgtcacctgtttgattccagcttttgtctccttacctgttgagtgtctaaactctctggtacgttca

SEQ ID NO: 506 - DNA, 76 bp, Arabidopsis thaliana
ttgagaagactctgagtcgagcagagggtttcacttgtgctctgtttctgttgactgaagcttctcctttatactc

SEQ ID NO: 507 - DNA, 99 bp, Arabidopsis thaliana
agagatacttggaagatcagttggttttggttagatctgtttatgattgtggtgaagaagatcaagatcaagatcaagattccgatcaaattattagag

SEQ ID NO: 508 - DNA, 123 bp, Arabidopsis thaliana
agatccagcatagactagttcaaagaagaggatatatacttactaaaagccttgtgatttagttcttcaaaggcaaccggacataagaggtttttgtaatttaattatgtcatgaaatagctc

SEQ ID NO: 509 - DNA, 105 bp, Arabidopsis thaliana
agatttggtgattcctcgtctcaaagaaatgcgtcaaaaacatttcccagagatgttgttcttgatggagtctatgaatagtaggaatgtattagttgatatgca

SEQ ID NO: 510 - DNA, 98 bp, Arabidopsis thaliana
ggagagaaatagagatagagagagagagagcttctgggtattttttaatggagaaggagatcttgttgttgctattggtcatcatgtttttaaccgtt

SEQ ID NO: 511 - DNA, 74 bp, Arabidopsis thaliana
actattatataggctcttcactgcatctactggctcgtgtttgaaacggtgtgtgtgtgtgttcaggagcagtt

SEQ ID NO: 512 - DNA, 142 bp, Arabidopsis thaliana
cactccaactgttatgctcgaatgggtgttcctccattatcaatgatagcagatgcgaaacttcttcatcatcctcctcatctgagaaagataagtcgatctctttcgccaggagctcttcattcagcagtgaggttacccg

SEQ ID NO: 513 - DNA, 85 bp, Arabidopsis thaliana
attggtcgtattcattaacatcaccaaattcaccatggttcaagaactctgtggatttctctgttgaagaagcaccgagctcagg

SEQ ID NO: 514 - DNA, 68 bp, Arabidopsis thaliana
tggtacttataagtatgtgtgttggttttcatttgaaagcttatgcatgggtgaagtgtgagagacca

SEQ ID NO: 515 - DNA, 125 bp, Arabidopsis thaliana
aggagtgacaagcacgtgcgagtcacagagagttgttcaagaagatggtgatatcattaatgttgttgatactcctggtaagctccccaattgtgtaaattgtttcacttttagtctattttact

SEQ ID NO: 516 - DNA, 126 bp, Arabidopsis thaliana
ctgtccaaaactatattgtggtttcttttgttgtgtgtggacttttgtataactatgttttcttccatgtttgaataagtgtatggaacttgattttgatgaaaacgatgatgatgagggacttga

SEQ ID NO: 517 - DNA, 66 bp, Arabidopsis thaliana
ttatacctgttgttgttgatgaaggagatgcttctcaggaaaacaaaccttctaacggcaacaagt

SEQ ID NO: 518 - DNA, 100 bp, Arabidopsis thaliana
tggttgtgttctagttgctacagagaagctagatggttatagaacatttgcgagaactgttgtgcttcttcttagagcaggtactagacacccacaagaa

SEQ ID NO: 519 - DNA, 111 bp, Arabidopsis thaliana
atcttcttcattatggaaagctacattggtgttggtgagggagagaaagtgcagcttttctactactttatcaaatcagagaacaatcctgaagaagaccctcttattatc

SEQ ID NO: 520 - DNA, 93 bp, Arabidopsis thaliana
agagaagaagattgatactttggagagtttgagaaagaattgggaacagaatccgaatgtgctttattcagagattgaagtttggtttcagaa

SEQ ID NO: 521 - DNA, 141 bp, Arabidopsis thaliana
agagactttagattcctcaatctccaaagtccagacatttgatcaaagatgtgtgtttgttatctatgtatctgtgtatatgaaatcaaaaagacaaaacttgagatcggaatcaatgatgtttctgtgtcttgtatatta

SEQ ID NO: 522 - DNA, 87 bp, Arabidopsis thaliana
aatgcctaactgcttctctatatatatagcaatatatggaccaaactgtggattttgatgtgtgtggagggaaaaggatgttcgtgc

SEQ ID NO: 523 - DNA, 131 bp, Arabidopsis thaliana
caagaaaaaaaaagataagatataattagtatcagtgaagtgaagtgtatctgtgtatagtatatatatcaatgcaccttactgctgccaaaaacccaagtgctatcatcatctgcagtgcatttacgttg

SEQ ID NO: 524 - DNA, 121 bp, Arabidopsis thaliana
ctggttagtctcttcttcttcatgatttcatttttgagaattgaaaggtggaagctttgtgaattttggattgttattgagagtgatgatgataagattttttagggttttgtttgaatgt

SEQ ID NO: 525 - DNA, 134 bp, Arabidopsis thaliana
attctgccaatgaacttgtactttgtagcttcaatctagacctaacattgggtattaaagcttctatatatatagaagctctgataccacatgttagttttagatcaaagtttcaaagtattaataaattggca

SEQ ID NO: 526 - DNA, 156 bp, Arabidopsis thaliana
agaaatcattttgtttattgacttgtaccttgaagctttgatttgaacctaaacctaacaattggtatcaaagcttctaaatagaagctctgataccaattgtgagagtcatatcaaagcttcaaggtagtagtcaatttggtagagaaaaaaata

SEQ ID NO: 527 - DNA, 128 bp, Arabidopsis thaliana
ccaattgacttgtactttgaagctttgatttgaacctgtcaattggtatcaaagcttctaaatctttgaagctctgataccaaatgatggaatcaaattaaagcttcaaggtagtagtcatcttggca

SEQ ID NO: 528 - DNA, 126 bp, Arabidopsis thaliana
tcaatctcgttccatcatgaccactaagccaatacatgtatgtatgcatctacgtaacgtatgcgtgtatatgtatgtgcatgtatgtgtgtgggatttggaggaatgggagagaaagaataaaag

SEQ ID NO: 529 - DNA, 92 bp, Arabidopsis thaliana
tgtttgttcctcatattgaaaagttatgtacgtatatgtgtaatattgttggtaaattaatgtatatacatgtgaaataatatacgtacata

SEQ ID NO: 530 - DNA, 138 bp, Arabidopsis thaliana
gagagtgtcttagtttagttttgttgctgctgattgctgaacttggaaaagttgtaatctttatgattgaattgttgatgaggatgaatagtttagtttcagcctcatgtgagttttgattttgtcttctcctctttg

SEQ ID NO: 531 - DNA, 94 bp, Arabidopsis thaliana
gaagtgataaaaggctgagactttgttgaggtttaaacaaatgatgatgaatttgtgtgtgtctttttaaatgtagctgtaatagttgtcactg

SEQ ID NO: 532 - DNA, 134 bp, Arabidopsis thaliana
aatttatataccagtgctaaactatgtggttgcaagttggaattggaactttctaagtgtatgtgaatatgcataaattgaaaccaaacaattagttgagcttgtgtactaaattattgtaatcgccgccaaaa

SEQ ID NO: 533 - DNA, 136 bp, Arabidopsis thaliana
gtggaatttactttagttgagagaaatcttgaagatggtttagttgaagagatcatattttcttctggtggtgagattgatgtttatgatcttcaaggtctttgtgataaggtagtttaaaacactactcctgtgc

SEQ ID NO: 534 - DNA, 90 bp, Arabidopsis thaliana
ccaacaagtcagaacacgccgagccaagttcaaataccactgaattctctaaacttatggtttgtgtgtgtcttcatggtcttgttgaga

SEQ ID NO: 535 - DNA, 89 bp, Arabidopsis thaliana
tcataccatgaagtgcttcatcaaggctaccaccgggcaagtaatcatataacagtagctttgatgttggtgaattgcaatatccacgt

SEQ ID NO: 536 - DNA, 112 bp, Arabidopsis thaliana
actgctcttctactaaattggtaaactataagggtaaattaggcatgattaatcaagagtatgttgatgatggtggttttcccctaaagttaagtgtgtgggttctagagga

SEQ ID NO: 537 - DNA, 139 bp, Arabidopsis thaliana
ttatcaaattatgtcttgaccgtttccgttgattatctttgtcataaaatgtatcatattgcatgcatatgcatgtgagtgtgttattctctatataagaaataaacgagtgactctctatgaatgacatgtaaaaatt

SEQ ID NO: 538 - DNA, 100 bp, Arabidopsis thaliana
aagatggaagtgattgaagtgtagatgattgaacagaggagaaagagcaattccatatctctacctctgtctctctatctctatctgatctttttcaaaa

SEQ ID NO: 539 - DNA, 121 bp, Arabidopsis thaliana
ggttgattctatagactgttcaaactttttagtgatattttatgagatgatggattgatttcttcttcatctttaaataaaatgtttactagatctcatagtgaatagagaccagatctaa

SEQ ID NO: 540 - DNA, 131 bp, Arabidopsis thaliana
ctttttagctcttctattctctttgttgttacacttatctacttattatgtactgtatctgcttctccttctctgcacccagatgaaggtttagtagtttcaatgcattatatcatatatacatgtgcctc

SEQ ID NO: 541 - DNA, 108 bp, Arabidopsis thaliana
aaagactctagtgatatctcaaggtgttctcaaggaaggacagaacagcacaatcagatgtgactgtcatttcaataactacagcacttgtcatatcaaacacttgta

SEQ ID NO: 542 - DNA, 85 bp, Arabidopsis thaliana
caagtaagtttcctgatgatgcttcaatgttctaattttaaaagtttaggtaggcaagaactcattggtgtgttgtttggaaata

SEQ ID NO: 543 - DNA, 89 bp, Arabidopsis thaliana
tgcaagtaagtttcctgatgatgcttcaatgttattttgaaacattaggtaggcaagaactcattggtgtgttgtgtggggtctcttgg

SEQ ID NO: 544 - DNA, 94 bp, Arabidopsis thaliana
tcttcttccatgcaagttcgaattgtaggatacaaaaaaaaatgtctctcttctcttgtcaacttgaacaaaaccacttggaagatgattttcc

SEQ ID NO: 545 - DNA, 135 bp, Arabidopsis thaliana
taaaatataagtattatttaatcacattaagaaatatgcacagaaactttttatcataattatatgtatgtacatgcattagtgcatatatacatacacaaatgagtgtataaaagcttgaacccatcgaacaag

SEQ ID NO: 546 - DNA, 128 bp, Arabidopsis thaliana
ccttccaaaaatcatgttacattgcttaatttatgtgtgtgtgtgtcagtgtattgcttaatttatgtgtgtgtcagtgtatataaatatatgcagcgtaagaagagaaggatcagaccaaaactatt

SEQ ID NO: 547 - DNA, 93 bp, Arabidopsis thaliana
ctttcgttgtataatttcatgatcatcctcttctttctgtccatactaaaaagattaggaggatgaaaatggatttgatctgatagaaacata

SEQ ID NO: 548 - DNA, 134 bp, Arabidopsis thaliana
ggacgtgacaacggtatgctcttatattccattgcattaagcactaataaaaatttaaggtgcattttgtttgtattttctctagctgaaatgaaagggtaatatgtggttcttacttggatcatgatctacga

SEQ ID NO: 549 - DNA, 93 bp, Arabidopsis thaliana
tcttgtgaaaaagaatcattaccgtattgttaactttggtttgaatcttctagattgaataagatgatgatgatgatgattcaactggatttg

SEQ ID NO: 550 - DNA, 142 bp, Arabidopsis thaliana
gttaagcaaacactgtactacgtggttgtggtttcatttattgccatattcttttttgaatcataatgatgatgatggtgattttctattttgttgcataggtgggattggaaaagcttatcatgatggggttgagggttta

SEQ ID NO: 551 - DNA, 101 bp, Arabidopsis thaliana
attatgtattttttatttatttgtttatttcatcgtccaaatttttgacagtatttttttgtttgttagagaagggcgagagagagtgactttttttgttt

SEQ ID NO: 552 - DNA, 73 bp, Arabidopsis thaliana
gacttcgacattaacaagattgacgatgagatcttccttgagagcatcatcatcatcatcggtgttggagtga

SEQ ID NO: 553 - DNA, 135 bp, Arabidopsis thaliana
ctttcaagtttttttttttttttttcattttaataagaattttctgattgagtgagaagttatgatgatggtgttacacagtagtatgacctgtgaatgtcatttcttttgtttgttcttccttttacaggaaag

SEQ ID NO: 554 - DNA, 98 bp, Arabidopsis thaliana
gacgcttcttctttatcgcagacgtcgcacctgatcttcatcgatcgattaagagagagatagagatggtggtagttgaaaatgataggagagaagat

SEQ ID NO: 555 - DNA, 124 bp, Arabidopsis thaliana
gagagaggacgaggaagagaaattattcctttgaaaatcttactttccattaattctctttgtttggaagcttgtgggaatgtaagaaagagagaggggtgtgatggtctctctgtctgtcaga

SEQ ID NO: 556 - DNA, 76 bp, Arabidopsis thaliana
agatgttgcgtagaacagaacttgtagttgatacaaagtcgaaagactcagcgaacaaggtgttgatgatgatgta

SEQ ID NO: 557 - DNA, 102 bp, Arabidopsis thaliana
aagttgttaccatttgagccgtaggttgggatgatgtatattaatggaagagacaacaatgtcaatggtaatgtacttcctaccttttatttgtggcagaca

SEQ ID NO: 558 - DNA, 74 bp, Arabidopsis thaliana
aagtttacaacgatcatgttgttgggatgccagtttagttttggtaaaccgacttatatatttgttattgctag

SEQ ID NO: 559 - DNA, 72 bp, Arabidopsis thaliana
gattcctgagaatcaaagcaggaggtcccttgtgttgaggtggttctctgattccaatacccaatcccctct

SEQ ID NO: 560 - DNA, 75 bp, Arabidopsis thaliana
ctttgaactattcttcatctgttgatttgcaattccgtggagatttggtgaagaagaagatgaagaaacagagcc

SEQ ID NO: 561 - DNA, 109 bp, Arabidopsis thaliana
ataggagtcacacgtatataacaaggcaatgtgttgtgtgtatctagatctatttatatgcaactgtttagaaaatgtactaatcctaaattattctacacaaatattc

SEQ ID NO: 562 - DNA, 78 bp, Arabidopsis thaliana
tttgtctcttacatctctgtgttttagtttctctgtgttgattacttagatttgtgatgcagatgctgcattgagaga

SEQ ID NO: 563 - DNA, 105 bp, Arabidopsis thaliana
gttggatgtctcctagagttcctctgagcacttcattggggatacaatttttctaaatgattatccactgaagtgtttgggggaactcccggacccattcaacgg

SEQ ID NO: 564 - DNA, 136 bp, Arabidopsis thaliana
ctgagtacaagaggtcaagattatcaagaaacaggaggactgtaaaccgagcatacggtggagtcttgtctggttctgcagtcagggaaaggtttgttgtccatcttacttgagtcatctttctattacaataaat

SEQ ID NO: 565 - DNA, 147 bp, Arabidopsis thaliana
aattgttattagatatctcagacatttcttttgcatgttcttggtcattagccgtagtatgtcatatatatatatatatatgccttgtatcaatcaactcatgtgcataccaaaaactactaatcacattgcaatttatatttttgg

SEQ ID NO: 566 - DNA, 92 bp, Arabidopsis thaliana
gagcacctcttgagaactttaagaaagaggtttcataatttaaagacgttcacgtttgtcttcttcttctacgtcttgaatctctcgaggta

SEQ ID NO: 567 - DNA, 68 bp, Arabidopsis thaliana
aaggctggggtcaacggtacaagtgatactatacgtgttgatgatgttgatgatcagcctctctcttc

SEQ ID NO: 568 - DNA, 99 bp, Arabidopsis thaliana
agtgtgatttttacttcaaggttgaatgatgtgtttgtgtcatgattgagatatgcgtaaaatgatttgaacgagtaattttttgcacattgttaatat

SEQ ID NO: 569 - DNA, 104 bp, Arabidopsis thaliana
atggtgtacgtacatattcgcttaagaagttagttaaactatgtttcaggatagaggaaatgttgttgttggtaagactatctgcttaggttcaatgtctggga

SEQ ID NO: 570 - DNA, 96 bp, Arabidopsis thaliana
atgattatcacatcatgctgaggtgagactttatttctgtcgattcatttttcatgatgatgatgatggtgatgatgatgattttgatgttctatg

SEQ ID NO: 571 - DNA, 117 bp, Arabidopsis thaliana
agatttaggaaagatttgggtgatgtgggatccaagtgttcaggttgttgttgttgctaaatctctgcagatgatcacttgtgaggttttgcttcctggctctccttcttggatcat

SEQ ID NO: 572 - DNA, 94 bp, Arabidopsis thaliana
tgtttaaaccaaaagatcttcccttgaaatacctttggaagagccgttgaacatcctcgttcttgttcttgttcttggaggtcatgagggtatt

SEQ ID NO: 573 - DNA, 82 bp, Arabidopsis thaliana
gacatgcgtgctgtgtcattgactcatttgtataatttgagtgagtctctctgtcactgtcgttttctatgtctctctgctt

SEQ ID NO: 574 - DNA, 75 bp, Arabidopsis thaliana
tgtacgtgtgtgtgtttgtcttttaaatcatgtttgatgtctagatttgagaataaaagtcatacaagagcatat

SEQ ID NO: 575 - DNA, 98 bp, Arabidopsis thaliana
gaacggcttctacacctactggtggtggtgctgctgcttctacacagcagactggtaaacagacgcagccggcagatcataagtgagtgtatatatgt

SEQ ID NO: 576 - DNA, 100 bp, Arabidopsis thaliana
cctcttgtcgtcttcccattcacggtcatagattctagagcaatgtcaaggaaattgctattcttggatttggattttgcaattctgaagataccattca

SEQ ID NO: 577 - DNA, 102 bp, Arabidopsis thaliana
ttacatggttgaagggttcaatagtcaatggctataaatataaatatcaccgtatttttggaaactatatatatcacatttactttttgaatcgaaatcagt

SEQ ID NO: 578 - DNA, 85 bp, Arabidopsis thaliana; identical to SEQ ID NO: 378

SEQ ID NO: 579 - DNA, 82 bp, Arabidopsis thaliana
accaaagttgttgttgttgctgctgcagactgatctgtcccggttgagtattgagaaagtggcgatagaaactagtattgga

SEQ ID NO: 580 - DNA, 87 bp, Arabidopsis thaliana; identical to SEQ ID NO: 52

SEQ ID NO: 581 - DNA, 86 bp, Arabidopsis thaliana
tatctcaggtttccctaagattacacggcataacagaagatatcgtaaaccttcttcatcttgctctgtagctgaagccctgcaaa

SEQ ID NO: 582 - DNA, 96 bp, Arabidopsis thaliana
gataatatgtctagtgatgatgatgatgatgacgatttaggcgatgatttgtctcctgaagaaatggaagttgctacaatggttactgagattgtc

SEQ ID NO: 583 - DNA, 122 bp, Arabidopsis thaliana
aaaagcgtaacgaaactaacatgaataaacacatatctgtgtgtctctgtctctgtgtgaaaatgaagaaagagagaaatagagaaatgggttttacggtgtgaagacatcttgacgatcag

SEQ ID NO: 584 - DNA, 138 bp, Arabidopsis thaliana
taaatcatcttcaaatggatttgagaaatctttgacaccagaggagtatctaaacaaggtatatgatgatgatgataaggggaaccattagcagctctgtgatatttcatgcgtgtatcaattttttttttgtcttct

SEQ ID NO: 585 - DNA, 137 bp, Arabidopsis thaliana
acccaaaaataaggagatttagactttgtagatgtagaatttcaagtgtatctatacaaataggtgtatatatacgtatgcatgaggaagatcctttctaacaatgttacatttccttagacaaatctggcttctct

SEQ ID NO: 586 - DNA, 94 bp, Arabidopsis thaliana
aaaaaaaagagttctcctgtgtgtgagtgagtgtaaagtgtatatttaagaaaatgtgtttcttttcattgtcatggtctcatgggtggtggat

SEQ ID NO: 587 - DNA, 124 bp, Arabidopsis thaliana
aaactaattgtgagcacagctgagcagcacaaaatgctttgaccagacttgttctgtgtgtgtggaattaaagcatgtgcgtgggcttttgttgtactatccgtgagtcagatatagcatatac

SEQ ID NO: 588 - DNA, 103 bp, Arabidopsis thaliana
ttcaaatttagagttttctggatacttaaaagttaatatcgaagaagccctctctttgttagtaactaataagtatccagaaaactctaatttgaaaaaaaca

SEQ ID NO: 589 - DNA, 86 bp, Arabidopsis thaliana
tatttcagctatcacagtatctattgtctatgtctctgtttgagtttaaaggagagcttgattcatgtagaagttaatagtgctgg

SEQ ID NO: 590 - DNA, 99 bp, Arabidopsis thaliana
attttatatatacggttagatttagtgtgtgcatggatctaatccgtctagtccatgatctagtgtgtacaaatcaaccaaaagaatgaaaccaccact

SEQ ID NO: 591 - DNA, 118 bp, Arabidopsis thaliana
taatagagagcctttgtgaattgttggttagtgaaaacttaagtataacaaaactgattttgcttggttttgttatcaggtcatacccatggaagaagatcaccaagtgcttatacag

SEQ ID NO: 592 - DNA, 75 bp, Arabidopsis thaliana
tgaacccggtttgtacgtacggaccgcgtcgttggaatccaagtgaaccgggttcgtacgtacactgttcatcga

SEQ ID NO: 593 - DNA, 88 bp, Arabidopsis thaliana
tgaagatcaaccccaaattcctcgattacaaccaagtctgtgggaacgtcgctcttttggatgagctggttgaggctggggagatcga

SEQ ID NO: 594 - DNA, 79 bp, Arabidopsis thaliana
aaatgtgtgtgtgagtaagtgagggagtctcggactcaattagaggctcttctttcacattcttacattattacataaa

SEQ ID NO: 595 - DNA, 95 bp, Arabidopsis thaliana
aggaaaggctaatctttcgcatttatcaaattggtatcggggtagatcaatttacggtggtgttgttgactgttgaggcatgtgagctttttcat

SEQ ID NO: 596 - DNA, 90 bp, Arabidopsis thaliana
tttaggaagatgtttttagcgggtgtagtgccaaatgcagtcactattatgagtgctgtgtctgcttgttcatgtttgaaagttataaac

SEQ ID NO: 597 - DNA, 82 bp, Arabidopsis thaliana
atctgagagagagagagacggaggttgggtgcgtcgcagggaaattgtgccacgtcacccttcctctcttctttttctgttc

SEQ ID NO: 598 - DNA, 129 bp, Arabidopsis thaliana
atttataccattagttctctctattcttcttgtgttttgattctaatcatcgatgttctcttgttggttttgtatataagttgaggtaaaaagtggaccagatggtttcatggtgaagatgaaggatgg

SEQ ID NO: 599 - DNA, 78 bp, Arabidopsis thaliana
atttttcatgcacatctgcatttgcagcaactactttgatatgcaaagaatgttgtggatgatagagattatggatct

SEQ ID NO: 600 - DNA, 184 bp, Arabidopsis thaliana
ataagagaaaatggtgacatgaagaatgagaacttgtgtggtagccaaggatgacttgcctgcgttttagaccatatatatcaaagactcactcgatcgatagtcttagagttggttggtcgtcaggcagtctccttggctattcaaacaattctcattctcttcattcacatttctctttttt

SEQ ID NO: 601 - DNA, 134 bp, Arabidopsis thaliana
atccttggcctctccacccgactgtggataaattcaatatcattttcatcactaaattggaatatatatatgtacagtatcatggtttaaatgtttcggcattgaattgtctaacacttggcgtgaatattgtt

SEQ ID NO: 602 - DNA, 102 bp, Arabidopsis thaliana
tacactgtgatctaaacttatcgacttcttcttcttgtttttagatgtctcaaagaaggagcagaggaattcttgttgaaaccggtgaagctagcagatgta

SEQ ID NO: 603 - DNA, 81 bp, Arabidopsis thaliana
acagaggaaggctatagagattgatggacaaactgtgtctagggtgcttcatcatctttgtttgtttgtaaaactcttgtc

SEQ ID NO: 604 - DNA, 107 bp, Arabidopsis thaliana
taaagtcctcatgtttttccatcagttttttgttcgtttcaagattatgagtgtaagtaaacaaaaatcataattttgaaacgaacaagaaactgatgaaaaaaaca

SEQ ID NO: 605 - DNA, 125 bp, Arabidopsis thaliana
cggaggagaatggaggcggttgagatttgaggtcagagacggcggttatcagcctctccgtcgcggctgccggagatggcaccgttgatagagtccttgtttctaccgtgccaagtggtgctttg

SEQ ID NO: 606 - DNA, 78 bp, Arabidopsis thaliana
acgaagaagatgaagaagaggcaagtggtgataaaacagagaaaaagctcttacactatgacttcttcttcaagcaac

SEQ ID NO: 607 - DNA, 90 bp, Arabidopsis thaliana
ttcttcttcttcttactcttctgtttcgggttttgagagataataggtgctcgatggtctttgatgaagaggtatgagaagatgatgata

SEQ ID NO: 608 - DNA, 121 bp, Arabidopsis thaliana
gcaattaaattttattaaataaagagagaaagacatacaagtaaaagctgggatggatcttgttgatggtgataatgctgaacgatgaagagaactaaaccagcgacagagaaagaaccaa

SEQ ID NO: 609 - DNA, 92 bp, Arabidopsis thaliana
tctaaggccatcaatgttatctggtaatatatgtatttgattttcagtcttcacattttgttgttgacttaatttatggctctagatataca

SEQ ID NO: 610 - DNA, 96 bp, Arabidopsis thaliana
ttcacagaatctctctatctcttctcttctcttctcaatctccctctgagagcattgtgcttctctatgatgatgttgcagagagagagttcctgc

SEQ ID NO: 611 - DNA, 111 bp, Arabidopsis thaliana
aacaactccataactgtaaacatctgattccttgctcctcaccgtcttgtacgcattttctgtttgatagaaatatggtcatcagagcatgaataaggtaacggtgaacaa

SEQ ID NO: 612 - DNA, 121 bp, Arabidopsis thaliana
atcaaatttatgatatggttgatgctgaaggatctaaaggcttggctgtgatggaggtattcatttgatgggtttgccttacagtttttggtattaccttatgtatttggctgaatttttt

SEQ ID NO: 613 - DNA, 83 bp, Arabidopsis thaliana
gcagaggttgaagcagcagcagcagcagcaacaagttatgatgcagcaagctcttatgcagcaacagtctctctaccatcctg

SEQ ID NO: 614 - DNA, 148 bp, Arabidopsis thaliana
agagaagagacagaaccaaaacgaccgtttatgcgtccaaccagtctatgaacttggtttttgagcttttgatctgtatatatataaaacacatcttataaaactgaagatcaatcttatagaaatatagaagcataatagaatataa

SEQ ID NO: 615 - DNA, 100 bp, Arabidopsis thaliana
tccactgtaagagctacacattcggctcctgatggggtcaatcaaagtcggattggttttgttgcagatgttagacgcatgaatgttgctctcactagag

SEQ ID NO: 616 - DNA, 79 bp, Arabidopsis thaliana
atcacatgagcattttagcttattgagcaaggtgtttacttatatagttatagttatgcatgttcatgttgattgtgaa

SEQ ID NO: 617 - DNA, 83 bp, Arabidopsis thaliana
aaacttcgaaatctatatctgcaggtctcaaaagccaaaagagtggcaatgatgaagatgctagataatggattcgaagacaa

SEQ ID NO: 618 - DNA, 106 bp, Arabidopsis thaliana
tacaggtgaaggaagtgaaaaggtccaggatcttctgcttcttgatgttgctccgcttagccttggacttgagacagcaggtggggtcatgactgtgttaattcca

SEQ ID NO: 619 - DNA, 88 bp, Arabidopsis thaliana
aaggcatgaggttttttatgttacagtggtgatgatgttgatgggaaatattctcattctgttataacttatcaaccaaatgctgaat

SEQ ID NO: 620 - DNA, 96 bp, Arabidopsis thaliana
agctaagaagaggaaaacaacaaaggaagataaaccagaaatgagttagctacgatcatgtatatatatgtatgtgtggttgtgtactttaatgga

SEQ ID NO: 621 - DNA, 123 bp, Arabidopsis thaliana
tatgaaaatattgcaggctttggtagttgaacaagtgaacctgaaccattttcatgttgttagtgttgcagctacaaaaagtcctgtgatattcattggaacaggagagcatatggatgagtt

SEQ ID NO: 622 - DNA, 89 bp, Arabidopsis thaliana
agtcttctttaagaaacgaccaactctctgaattgattttgatgtaggtttcatcatctttcttgctgctcatttttttgagaagataa

SEQ ID NO: 623 - DNA, 83 bp, Arabidopsis thaliana
atgtatgtactctctctctatttctgtctctgtcttggaattttgggtctgatcatggagaattggagatatatgaaagagtc

SEQ ID NO: 624 - DNA, 88 bp, Arabidopsis thaliana
gggatatttgatgtgactggttttgtgttgatgcagacattcttagaatggaaggcagcaaggagacaagaagtgagtgagtatcaaa

SEQ ID NO: 625 - DNA, 104 bp, Arabidopsis thaliana
aaaaattgcagataacaaaatgtggccacagtcaatcctggacattgcaagaaagatgtgtgtctgtcatcagctttgtttctcacgtaattttgaattcatga

SEQ ID NO: 626 - DNA, 90 bp, Arabidopsis thaliana
catggtttaacattctgaaactgagctttgtttttgttgtaacttacagacaacagatacaaagacgttgaggttgagatgccaaagtcg

SEQ ID NO: 627 - DNA, 89 bp, Arabidopsis thaliana
tttctgtgtttggtaacacgcgaggattggatgatatctatatattctaatgtggactaaaaatgtgtgtgtgtgtatgaagatgggaa

SEQ ID NO: 628 - DNA, 76 bp, Arabidopsis thaliana
acgcctccggattcttgatgatgcaggagcagagccctagttagtatcatcaacaagatcatgcgtgacacgtttt

SEQ ID NO: 629 - DNA, 133 bp, Arabidopsis thaliana
ctctctctctctctcttgctttgttgtttaataattgggattgagtcttctgtgaggtcaatatatatatagctacagtccctttctttattttctctaataaaggaaagaaatccatttttttgtaaaaaga

SEQ ID NO: 630 - DNA, 121 bp, Arabidopsis thaliana
ttttactttggatctttctttctctatgctctgttttgaaatgatcttattatagatttatttgatgattgagtttgagttactttagatgcaggagatgagattgtagagaagaatcagg

SEQ ID NO: 631 - DNA, 94 bp, Arabidopsis thaliana
tgaacttgaagggaggctttaaatttgctttcttcagataagaatccggatgaatctttctgtgaatgtgtgtcgtatatgtaccctttaggag

SEQ ID NO: 632 - DNA, 69 bp, Arabidopsis thaliana
aggtacgagaccatgagggccaatcctttgccttttgtgaagagattggctgagttcatgggttatgga

SEQ ID NO: 633 - DNA, 128 bp, Arabidopsis thaliana
gacataaagtcgcatttaattaaattcatgttttaatacagtaatgaaatctaagtttggttgcttgatattcttcatgatggatttgttgacttcttgaatcttgatactattattcacgcaacgaa

SEQ ID NO: 634 - DNA, 108 bp, Arabidopsis thaliana
atatgtataatcagttggcgatatcttcgtcttcttcatcttcttcgtactatgaatctttgaaggttttggaagctgatgttcaacacgctaattctttgtaagtcc

SEQ ID NO: 635 - DNA, 122 bp, Arabidopsis thaliana
agaaaaattggtctacacatgacacatgaaaaagatgtactgacgtgcacgtgtatatctatgcatatatacgtacgatatatcttacagtatttgcatgacagaattcaatccaacacgct

SEQ ID NO: 636 - DNA, 87 bp, Arabidopsis thaliana
agtaatggagattggtgagatcttgctctgtgattctctccttcttgtctccgagtgttgtcctaatctcttcttgcactttcttca

SEQ ID NO: 637 - DNA, 132 bp, Arabidopsis thaliana
caaaactgagctcagtcaatcagagttgtttgatcctcgtcttcaagctaagatattgaatgttgttgatgtttcttacggaggtgaaaacggtttcaaccaagcgattgagctgtctgctgagattctatc

SEQ ID NO: 638 - DNA, 129 bp, Arabidopsis thaliana
ttgattgcttaacactaactcagttcttgcaaaagtatgcttcatttgtacgttaacttgtgtgtttgttggattgtctaacacaagctcttcaaaagtgtgcttttgtaaacctgaaattgtgttttg

SEQ ID NO: 639 - DNA, 92 bp, Arabidopsis thaliana
atcacaccttatacatacgtttgcctcttgaagtggggttgcaaaagatattgtctctgcttgaagctgaagatgctgatgtgaggattcat

SEQ ID NO: 640 - DNA, 284 bp, Arabidopsis thaliana
caatgattatgcgccaaaggggagtcatattctcatcaaagatggattcgggattacgcctctgtatgtatgtatggtcgaagtaggcaaaatctcacctttctagcagatcaacaatgaattttgtggaatagatgttggatttgtaaggttttggtgtttgcaagtgttgagatgcgcaagatttgagtaagatttttcctactccgcccataccatacatacacctaatcctgagtccatctctgatgggttactactggagtccaaaactaataaagcct

SEQ ID NO: 641 - DNA, 93 bp, Arabidopsis thaliana
gatagtcttgatagcactaattgttgtgtgcattggtgttcgaacttcgaataatacagtgacatgccaaccttgaatttaagaatcatcatg

SEQ ID NO: 642 - DNA, 143 bp, Arabidopsis thaliana
cataaaatatacaaacaaaactcaaaatcaaattcaaacatatcaacatagacatgcataatgttcatcatcatgatcatgatcatgaattcatgatcaatgacccattggaatactcggctcatcatccaactcaatcccca

SEQ ID NO: 643 - DNA, 85 bp, Arabidopsis thaliana
aaactggtgatggtggtggtggactgtatgttactgggggatagtataccggtgatggtggtggtggactgtttgtcaccggtgg

SEQ ID NO: 644 - DNA, 134 bp, Arabidopsis thaliana
gagaaggtggaggaggagaagggaaccgtgaggagatttgtgagttttattggtgagaaagtttttggtgtttggggataagaaaattttgctacaaaattacaagaaataaaatgctcgaaatggttttttaa

SEQ ID NO: 645 - DNA, 72 bp, Arabidopsis thaliana
attgtggactcattgaacaaagcttatgagaagtttgttcttgcttcagctggtgttcttgagtctaaagag

SEQ ID NO: 646 - DNA, 102 bp, Arabidopsis thaliana
aacgcgagatattagtgcggttcaatcaaatagtcgtcctcttaactcatggagaacggtgttgttcgattgagccgtgccaatatcacgcggtaaaccaaa

SEQ ID NO: 647 - DNA, 82 bp, Arabidopsis thaliana
tcttaagtttgccaaccgcccgaaatcaaaagccgttcatggacttatgaatggtgggcgtgatgtggtttttggtccctat

SEQ ID NO: 648 - DNA, 110 bp, Arabidopsis thaliana
ctcctacctcttcatcttcgtcatcatcatcataacgatcgtcaggaagatcttcaacgccatcatcttcctcttctattgatgattcactgcgataaggagaaacattg

SEQ ID NO: 649 - DNA, 83 bp, Arabidopsis thaliana
aactcaaagagtggaagctccttgagcttgatttggttagaagcagactcattatcacttgtaagtgcttccattctcttaaa

SEQ ID NO: 650 - DNA, 79 bp, Arabidopsis thaliana
gttcagttaatagatatgcatatctacggacatttaaagctcacaaaatcaaatgtgtgtatgtttgtagatatcacaa

SEQ ID NO: 651 - DNA, 94 bp, Arabidopsis thaliana
ttttttagtacaacttgagacagatgtgcatgtgattgattcttcttgtgtgatcaatggaacagtctacagggacatacattgctgtatcgag

SEQ ID NO: 652 - DNA, 135 bp, Arabidopsis thaliana
gaacttttttatatttggtagcttatctcttgtgattctgattcatgtatctcctgtggttttatatatatgaatagttgagtgatgttggagagagtttatatgatgtgttcactattcacccaagttttagtt

SEQ ID NO: 653 - DNA, 124 bp, Arabidopsis thaliana
cagatggtctgaacactctcctggacatcgggtgggaaggaagagaatccatgggaggtattctgatgatgattctgctgatggagatgactatggtaggagagggacgggtcacaaacgaaaa

SEQ ID NO: 654 - DNA, 248 bp, Arabidopsis thaliana
agtagagctccttaaagttcaaacatgagttgagcagggtaaagaaaagctgctaagctatggatcccataagccctaatccttgtaaagtaaaaaaggatttggttatatggattgcatatctcaggagctttaacttgccctttaatggcttttactcttctttggattgaagggagctctacatcttctttcaccttctctattttttatttttctttatttctactcaacaattatttattcgg

SEQ ID NO: 655 - DNA, 84 bp, Arabidopsis thaliana
aaaggagctggaaaatcgtcgtcgtctgctcagtttcacctgaatgtgaaggcggagcctgatcctagattcgtttttcagttt

SEQ ID NO: 656 - DNA, 91 bp, Arabidopsis thaliana
ttaagaaaccctaagtgatgatgatgatttgtaggtggtaatggagaatagatttttacaattaactttatcaaatcctgagggtttcgtc

SEQ ID NO: 657 - DNA, 109 bp, Arabidopsis thaliana
gtagtagcgttttctaggccaatttctatagagttgtataaccaaacgggcttgtatgtgcctgtgagtttgtctttaccgaatccaagcctagagactctgtatccaa

SEQ ID NO: 658 - DNA, 77 bp, Arabidopsis thaliana
ccgtccctgctgctgtagctgcagctgctgttgttgcatcttccatggttgctgctgctgctgccaagtctgcaaac

SEQ ID NO: 659 - DNA, 125 bp, Arabidopsis thaliana
tagttttggtgggggataaatgattataatttgcatcattgcatggttacgttgatcttcatgcagtgcaatagaaggtttacattgtagctatgtatggaaaatattattgaagtaaccattaa

SEQ ID NO: 660 - DNA, 94 bp, Arabidopsis thaliana
aaacaacatcatttcacttgaccatgtctcagttaacacatgtaatggctttgtgtgtgtttatcagggattcaaagttaaggccaagttttgc

SEQ ID NO: 661 - DNA, 67 bp, Arabidopsis thaliana
ttaaaacatctctctctatatatatgtatgtatataaataaatatatgtatgtgcatgtatatataa

SEQ ID NO: 662 - DNA, 72 bp, Arabidopsis thaliana
gtctctctttctctctctctctctctcaatgtgactagttagaaacaagagaagatgaatggagagagatca

SEQ ID NO: 663 - DNA, 87 bp, Arabidopsis thaliana
acgttaacgtcttaacgaatatgtgttttggggaatgtagtaatgaggaaacttatctcacctctcgatgctgtcagaagactaaag

SEQ ID NO: 664 - DNA, 91 bp, Arabidopsis thaliana
acgcacttattagttctatacatatatcgatcgatatagcatgtgtttctagagctcttaggttcagtgattgatcatgtgtgtgtgtgtg

SEQ ID NO: 665 - DNA, 112 bp, Arabidopsis thaliana
tcatctcgaataggagtaatttattttgttagcatcttcttcaattgatgctaatggatggttgatgatgatgttgcaggggagtaagagtggatctgagatggaggtgaca

SEQ ID NO: 666 - DNA, 95 bp, Arabidopsis thaliana
tgtgatagagagagaacagagacgccaattatgagtagagctgacacgttggagctgactctgtctctatctctatatctctgtctttctctatt

SEQ ID NO: 667 - DNA, 89 bp, Arabidopsis thaliana
tttttcatgtgagatgggtgtgtgtgagttatcattgcataggttatcatttacagttgtagttgcgcatacgaattatttatgaacta

SEQ ID NO: 668 - DNA, 116 bp, Arabidopsis thaliana
agaatctgtatagatgaaagtgaaatgtggctactactcgaatattgttgatgatgcttattataaaggggatcaataattattcattgattggaatatttgattgttatataagt

SEQ ID NO: 669 - DNA, 103 bp, Arabidopsis thaliana
gaatgatcgtgagatattgtaacagagagggggatacttgcgtcaccagcagcaggtgacttgtgaatttgttgtgataaagatcacattaatttaaataaaa

SEQ ID NO: 670 - DNA, 103 bp, Arabidopsis thaliana
aaaaaaaaaaaaccattttgttttgggacatatatacatatattgaacaaaaacaaatatcgttggtcatatatatattttcccgatcaaaaagtctggtaaa

SEQ ID NO: 671 - DNA, 128 bp, Arabidopsis thaliana
tgttcctggtgatattgtggaactgagggttggtgataaggtgcctgctgatatgcgtgtggttgctttgatcagttcaactttgagagtcgagcaggggtccttaacaggagagagtgaggcagtga

SEQ ID NO: 672 - DNA, 95 bp, Arabidopsis thaliana
ctgtaggtggaggctgccggaggaataacaagaagggcaaaaatggaaatttaaaatcttcttcttcttcgtccaaacagtcttcctcggtcaac

SEQ ID NO: 673 - DNA, 94 bp, Arabidopsis thaliana
aggagcttctttttcttttacagtcatcttgtacgaatctgtgtgtcagtgtgtctgtgtgaatgcatgatcctctataaattttccttaatta

SEQ ID NO: 674 - DNA, 97 bp, Arabidopsis thaliana
aacacaaagatggacgagaagtggaggctgtcgaaaaaggatgcattagctgcgtcgtgttcatcttcttcaacttcatctaaatccaagttctcta

SEQ ID NO: 675 - DNA, 97 bp, Arabidopsis thaliana
aagggttgggcaacctcactgtctgctggtgttggggatgatggaatcaaccgctcgtctctagcatatgtgttcggcatgtccatacatctcactg

SEQ ID NO: 676 - DNA, 132 bp, Arabidopsis thaliana
aaattcatacttgttttgtaatcgatacatgatatgttctttactgttgcacctttccatattgatgatgatgttagggatgttgtatcttgaaaagaacgtatttgcatagatgagtagtagtatgcaatc

SEQ ID NO: 677 - DNA, 93 bp, Arabidopsis thaliana
atacatagctaacatccatctatatgttctgaatgtgctctttctttgctgattgctcttagactacatagaaaagtgttgtactatggtatt

SEQ ID NO: 678 - DNA, 73 bp, Arabidopsis thaliana
ttcgtcttcgtcttcgtcggcgaagtggaagcgagttgagataataatgctgacagagatagtagacggagta

SEQ ID NO: 679 - DNA, 75 bp, Arabidopsis thaliana
gaagctgcaggaactttgtgtgtgtgtttgaagatagattgattttggagtcgcaaccgcaggttgttggagttt

SEQ ID NO: 680 - DNA, 70 bp, Arabidopsis thaliana
aacagtagcagatggcgtctgagacgggtatgcaaaagtgcttgcaggtagatgagtaagctgcacatac

SEQ ID NO: 681 - DNA, 88 bp, Arabidopsis thaliana
aattggtcagtcgaaagcaaagtttcagatggaaccaaacactggtgtaacttttgatgatgttgctggagtcgatgaagccaagcaa

SEQ ID NO: 682 - DNA, 86 bp, Arabidopsis thaliana
aggagaaaattgtcatgtgttggtatcttctttgatcaagcacttggatcataagaatgtaataaagcaacaaggtcttcaaatta

SEQ ID NO: 683 - DNA, 78 bp, Arabidopsis thaliana
gaagaagctagagaggaagaagagccaagtgttactggaaggttacgttgagactgcttcttcttcctcggtggatga

SEQ ID NO: 684 - DNA, 95 bp, Arabidopsis thaliana
ctgcgttgctgtttttgtttccattcattcggcgctatcttgaaaggtctgactataagataatgatgctgatgatgtggtggtctcaggtagtt

SEQ ID NO: 685 - DNA, 97 bp, Arabidopsis thaliana
tttctgtgtgcatactgatctcctatgtttgtggtttcttgtgaagtgtgtcttctcttgcatggtttatgtcaaatcaagagaacagttttgtaac

SEQ ID NO: 686 - DNA, 72 bp, Arabidopsis thaliana
atggctgtgtgagaagcttgaagctctttatgaagctgaattgctttctcttcaagcacatctcggtcactc

SEQ ID NO: 687 - DNA, 113 bp, Arabidopsis thaliana
atttgggataccatatcatcggatttagacttgtctacttggagttgtgcttgaagctttacgagctcattctttgtgctctgatatatctcattgacttggtttttctcttc

SEQ ID NO: 688 - DNA, 83 bp, Arabidopsis thaliana; identical to SEQ ID NO: 67

SEQ ID NO: 689 - DNA, 78 bp, Arabidopsis thaliana
atgctaatgaaatagatgtttgatgattttcaagcagagaaggaggcttggagagattaaagcgccgtctggttggca

SEQ ID NO: 690 - DNA, 133 bp, Arabidopsis thaliana
gcaattaggtttttatgaattggaggaaatttgcaatcttttgtgtttcccagttgagagggttttaggttttaagatgatggaacttgagttgtgtttctccttgtgaaagattgagtctttgtaaagcttt

SEQ ID NO: 691 - DNA, 103 bp, Arabidopsis thaliana
attgatcccttgcgaaccagtcagtacttgacaagagatccgaaactattaaatgattttgttgactgaagattgcattgtggtggtgatgataaaaatttga

SEQ ID NO: 692 - DNA, 95 bp, Arabidopsis thaliana
taaaaaaaaacattagtctctctttctctctgtctgagtcttaaaaatgcataagctgctaaagagaacaaacaaagcgaaaacgagacaacatc

SEQ ID NO: 693 - DNA, 76 bp, Arabidopsis thaliana
gaaagcaattatctagttgcatgttttgatagtagttatcgggatactgtttctatgtagatagattgttttagta

SEQ ID NO: 694 - DNA, 72 bp, Arabidopsis thaliana
tggagatggtttatatgtgtttcactttacttaccttcaggtgctgattgaggcagtagaaaaccatatgcc

SEQ ID NO: 695 - DNA, 88 bp, Arabidopsis thaliana
ctttggtttgtcggtaggaggcaacaactcttgtaatccaactccttctcctatttgattgttgttggcatctgctcgagaaactact

SEQ ID NO: 696 - DNA, 86 bp, Arabidopsis thaliana
gcaattgtgatttgtgaggaatggtgttattgtgttgcaattgcaaaaagaaatgctactcttgcagattcataccaaaaccaaat

SEQ ID NO: 697 - DNA, 88 bp, Arabidopsis thaliana
gagagagacatgaagaaatctaggggattcgatgaaagggagttgttttcgactgctgaatcttcttcttcttcgagtgtgtttttcg

SEQ ID NO: 698 - DNA, 85 bp, Arabidopsis thaliana
acccaagcaggagctagaaattctactactgcagttgatgccatggatgtagatgaagctcaacctgttggaagaaatagagttc

SEQ ID NO: 699 - DNA, 109 bp, Arabidopsis thaliana
tcagtagtacgtgttgtagtacgcttgaggagcaacagcagcagccggttgctgcaccggtgcagccgctggtgctgctgctgcaactggaggtgcataactctgcgtt

SEQ ID NO: 700 - DNA, 111 bp, Arabidopsis thaliana
cgaacttgatgtttcttttgtgatcatcttcgttatgatcaaaatcttcgacttgggtttttgagattttagattcgtgctttgagggtaaaaagtaagaatcatcgagac

SEQ ID NO: 701 - DNA, 137 bp, Arabidopsis thaliana
agaagatctctacaatcatctttctctttgttcatgaagaaagctgctgcttctgggaacttgttgttgtttgaggtttcagtcactccattcaatcgctcagaagggttctcgagcaccaagcttttcatagatga

SEQ ID NO: 702 - DNA, 79 bp, Arabidopsis thaliana
tactatagagagtagagagagtagaaaaaatgggttcctccatattattggttttgtttactctcatggttatgctgtc

SEQ ID NO: 703 - DNA, 150 bp, Arabidopsis thaliana
catagaacctcagctttctcatcaatcatatcgtctcctccttccacatcactataacattcatcttcttcctcatcaatatcatcatcatataaggacatggctgatccatatcccgagattcctgatgatgatgaagatgaagccgcc

SEQ ID NO: 704 - DNA, 117 bp, Arabidopsis thaliana
aatcatcatcatcttcattatcattatcaccatcgtctcctcccatttctgtcgctggcagaggaggaggagccggagggagaacaattgtgttagtaaaagttgacgatggcatta

SEQ ID NO: 705 - DNA, 102 bp, Arabidopsis thaliana
ggcggcgacgaagcatgaacatgacgacggagaacatgtgcatcccacgtgatgactttttcttcttcatgctcgtgttgtttatttgctctatctctaatt

SEQ ID NO: 706 - DNA, 106 bp, Arabidopsis thaliana
ctgtagggttttgattttcttcaatttatttgatgggttgttgaaaaggttcgatttttgtttgatctacagattggcgttagaggaggtgaagtttttgcagaag

SEQ ID NO: 707 - DNA, 137 bp, Arabidopsis thaliana
tttcgtgttttatatagcctttagtgttgttgttgctgaaatcagtgagtaaaatgctatttatgttcgtttgatttctgattagtaacatactcagcttctcgctgtccattgtattgtagtagaattcttgtaat

SEQ ID NO: 708 - DNA, 95 bp, Arabidopsis thaliana
tactgcatgcatcatatatatatcaccattaatatatatgcatcagcaagttaaccagcctatatatatgatgatgatgatgatgatgatgagga

SEQ ID NO: 709 - DNA, 87 bp, Arabidopsis thaliana
acagtacgaattcagaagaagatgaagaggagacggggagtgatttcattttcatcttcatcatcaattcatcaaattgtttgtatg

SEQ ID NO: 710 - DNA, 124 bp, Arabidopsis thaliana
ttcttagagcgggaagagttggcgaattataacttccaaaatgaatttatgaagccttttgttgttgtcatgcgcaaaagtggtgctgttgagatcagggaattgattatacgatgtgtctcac

SEQ ID NO: 711 - DNA, 68 bp, Arabidopsis thaliana
agtatatgtgtatgtctgtgtacttgctctttattttcaggcggtaacagatatctacgacatgtacc

SEQ ID NO: 712 - DNA, 135 bp, Arabidopsis thaliana
aaagcgatgcatctacatgtgattcttaggactggtctctgtgggtatataacacataaaagatatatatatgtgacgtgtgaatactgtgagcagtgggagctgaggaaaatgtgactagaaagagtaatatat

SEQ ID NO: 713 - DNA, 125 bp, Arabidopsis thaliana
cttgtaagtctttttcttttgttggtacattctctacgttaacttttgcaaattttgttttgttggggctgccggggatactttcataaggggaagtagcttgtttatggacgattcaattatat

SEQ ID NO: 714 - DNA, 137 bp, Arabidopsis thaliana
atgtctcatttcctgtaccgcttgtcttaaaacatgagtttaatgtcaagtttactatgtgagattcttgtgctggtgttctataggcgattctcatttgttcaattgttaaacaggctagagggattgagaaaatg

SEQ ID NO: 715 - DNA, 81 bp, Arabidopsis thaliana
aacagagattgaagttaaccccaaaacgatgaaagctactggttttgtgaaaaagcctggtgttcttgttggtgatctcaa

SEQ ID NO: 716 - DNA, 136 bp, Arabidopsis thaliana
tttttttttttttgttgttgttgtcatatctactatatatatgtatgtcagattgtcagtatgtgcatatatacatgaggttaccggtccatgtacataaacacattcaggtaaataactagaaaggttgggagaa

SEQ ID NO: 717 - DNA, 85 bp, Arabidopsis thaliana
aaactctcccgattctctcgctcgctcgctcagctcctcaacagtcacctgaaggctgaagaagaagagcaaagagagcagaatc

SEQ ID NO: 718 - DNA, 82 bp, Arabidopsis thaliana
agacataggctgctgtaactgttgctgatgctgcaactgttgttgttggggttgctgctggagttgctgctgctgttgttgt

SEQ ID NO: 719 - DNA, 91 bp, Arabidopsis thaliana
cctcaacctcgttgtcattggagattttgcttcttcctcctcaacaataaacctcatagatgacgacgaagatgatacattatgatttcta

SEQ ID NO: 720 - DNA, 72 bp, Arabidopsis thaliana
taatttgtctgctgtgtttctgaattctgttgcaggtaatgagtttttccaggagcacaagtatgctgatga

SEQ ID NO: 721 - DNA, 111 bp, Arabidopsis thaliana
tgtatttttgtcagtggtaccgtctccagtactgccgcctgatgaagctgctggaacaatgacagagagcttcatcccgccagtgcagtggccggggataccgcagatgaa

SEQ ID NO: 722 - DNA, 117 bp, Arabidopsis thaliana
ttggcatcgtagaaaattattttactttctctgtctctcaatatctctattcataagtttttctcttttgttggttttgagctgatgggaatgtgttttgcgtgttccttttttttt

SEQ ID NO: 723 - DNA, 113 bp, Arabidopsis thaliana
ttggttccatcttcttcggcactggatgctttctcggttgttacctctgctttctcttcaggtttctcctcagatttggtctcaaccggagcagcctctgatgatttctcctc

SEQ ID NO: 724 - DNA, 100 bp, Arabidopsis thaliana
agactctttccgttgggtcttcttatcaaatcgaatgggttttttactacttgtagactgatgatgatgcacctacaacatttgacgcttgagttctttt

SEQ ID NO: 725 - DNA, 86 bp, Arabidopsis thaliana
gttccatgatttgtgatgtttgaatgtttctgtcaggttaagataggcgcatgtgaacctgtagaaatagaatcatatagtcatga

SEQ ID NO: 726 - DNA, 123 bp, Arabidopsis thaliana
cttccaaggctcccattatgaaaagaaaaacgagcagacaaaaagaaaagagtttttttgttgtgaaagtggggatttagttttgtgatgtaggagatgagacattggagttgtatttatagg

SEQ ID NO: 727 - DNA, 77 bp, Arabidopsis thaliana
gggtttgtcaactttgtgagccctgaagctgctgcagttgctgttgaaaagatgaacggtatcagccttggggagga

SEQ ID NO: 728 - DNA, 111 bp, Arabidopsis thaliana
gatagtgatgctggtgttgagattcatccgattgacgaggaggaagaagaggaaaccgatagactttgggcgttaaaacatgacggtggagttatcggcgaagttaagact

SEQ ID NO: 729 - DNA, 82 bp, Arabidopsis thaliana
gaggtgggggaagaagacgatcttcgatccagagttgagcttctcttctgccatcgtcttcttcctcgatctcggtcaatta

SEQ ID NO: 730 - DNA, 84 bp, Arabidopsis thaliana
cgcaagtacaactacaccataaatttcagaaataacggtgagtattgtggttaatggagagttgtgtgtggatgtgcaagcaaa

SEQ ID NO: 731 - DNA, 101 bp, Arabidopsis thaliana
aattttcttataacataagtatgcgttagtccttctctgttcttgattctctagttaacattttcaacgaatgcgttacttcttccaaacagaggaggaaa

SEQ ID NO: 732 - DNA, 136 bp, Arabidopsis thaliana
tcgtttcctgttgcgtaatttggatatctctcgggctgtgttgtgggtggaactggaaactgctgatgctgctgatagcttactcctggaactgcctgttgatgaaaatcttgatagccatgagtaggatactgct

SEQ ID NO: 733 - DNA, 84 bp, Arabidopsis thaliana
aagagtcatggaacttcgagatggttctgatggtgattcagctggttgtgcatctcttgccactgtctcacaaagttcctttta

SEQ ID NO: 734 - DNA, 135 bp, Arabidopsis thaliana
caacggtaagaatcaggtacttcttctgagagattaattgtggatagttcaatgtgatagctcacttgtgcttctgatcttgcaggaggaagtctccagctccctcgcctccacaaatctgctagtagagtgcct

SEQ ID NO: 735 - DNA, 74 bp, Arabidopsis thaliana
ggatagatcagtgttgactccacatcgaaggttgagaccgagagcttgatctgtagtgatgttgaactgagcga

SEQ ID NO: 736 - DNA, 91 bp, Arabidopsis thaliana
ggatgttttctagagttcctctgagcacttcattggagatacaattttttataaaatagttttctactgaagtgtttgggggaactcccgg

SEQ ID NO: 737 - DNA, 126 bp, Arabidopsis thaliana
acaataataattcgactagatgtcctctagagttctcctgaacacttcattggaaatttgttattcagtaagctaacagttaattccactgaagtgtttgggggaactcccgatgtcatttggtga

SEQ ID NO: 738 - DNA, 94 bp, Arabidopsis thaliana
tagatagcttatgtacacatgaatgcatatgtgcgtgtgtatatgcatgcatagacagacgtataaagatggtgcgtggggtacttaggttaag

SEQ ID NO: 739 - DNA, 138 bp, Arabidopsis thaliana
ctgcagcgatgtctagagctatgaacttcagggagagcatgcaacaataatcagacactaatatagatatatattcatgaactgagagatttgagtttggctaattgttaccttgtggaagaaggcaaagctgtgtag

SEQ ID NO: 740 - DNA, 130 bp, Arabidopsis thaliana
ttaactggttcaaggtatgtttttgattcttgatccattctttgtttcgattagtttagttatgtttgattctttagtctccataaagttggctttctaggttagatttgatttttaccaccgactaact

SEQ ID NO: 741 - DNA, 130 bp, Arabidopsis thaliana
ttactaatcagtcttaatttaaagcacatatgttatgcaagctagttacgttaggtgttgtaatttcattgaagttatagctgttagtgatggttacatgatgtcatgattttgaaactagaaaacttta

SEQ ID NO: 742 - DNA, 130 bp, Arabidopsis thaliana
ctgtttgacttctttccaggtgaatttggactttgctcatcattgcgcttttcatcaccattgttgtctggttcttcctcagactgctgggatctgtgtgattgagctgcttcagagttcttctacaaac

SEQ ID NO: 743 - DNA, 122 bp, Arabidopsis thaliana
ttgtttaatacttcttcttctctttgttcttttctgtgtttgccttagtcagatctgcatttgttgttgtcgaaaccaaaacggtcgaagaagaagaagaagaacatcagagtactaagtta

SEQ ID NO: 744 - DNA, 95 bp, Arabidopsis thaliana
cgaatgcattataaaacccgtttccgagtcaaaaccaaactaatcacttgatttttctgtcattgtttattggcctatcggattggttttactgc

SEQ ID NO: 745 - DNA, 136 bp, Arabidopsis thaliana
actgtgtctctctaacttgtggtggattctgttgcagtgaatatcctttgtctatagttcttgttggtgttggagatggtccctgggacaccatgagacagtttgatgacaacatccccgctcgtgcctttgacaa

SEQ ID NO: 746 - DNA, 108 bp, Arabidopsis thaliana
gccttcgtcttcaccagtcgcccacaacaaaaagcttctctctctaggaaacacagagagagcgagagagtgaagttgaaagaaaatggctacagatgaggaaataaa

SEQ ID NO: 747 - DNA, 91 bp, Arabidopsis thaliana
aagaagccagactctgatgaagaagaagaagaatctatcctcttggctattgaggaaactctttgaattcgttatcttctttgtttcgatg

SEQ ID NO: 748 - DNA, 92 bp, Arabidopsis thaliana
attaaattgattcaaaaaggaatctcagctttctgttttgcaaaattctctgtttacaacttgaagcatatatgagattctattgtgaatct

SEQ ID NO: 749 - DNA, 133 bp, Arabidopsis thaliana
gacattttctgtcatgtttcggatgtcatccgctgatgctcatctggatataaccattttgattgttcttcatttgcagaatcagctcgagacacattattccggtttcaagacgcctcacatatataatttg

SEQ ID NO: 750 - DNA, 362 bp, Arabidopsis thaliana
agaagttaaaacacaacgtccgttacaactatcattctcactcactcatgtgagcagaaagagtagcatgatattttcttcaaggtctttaccaacctttcatcgttcccttctttgcaataacgctgttttgcaaaaccgtgatagtgctgagccgatgagcctctaatgaaattatagactcatcggctcaggaccattgcggttgtgcaaaacggtgttattgctgagaagggaacgcatgagaggttggtaaagacctcaatggaatcttatggtactctttttgctcacatgagtgagtgataaccatagctgaaaccaatgatgtgtttttctttttactctataactaaatatat

SEQ ID NO: 751 - DNA, 106 bp, Arabidopsis thaliana
aactcagaagaagtagaagaagaagcttctccgatctctcttctctcatctcgatctgtatgtgttcttcttcctctcgtcttctttctctatccagattctcaac

SEQ ID NO: 752 - DNA, 82 bp, Arabidopsis thaliana
atcatcatattcatcttcatcatcatcgtcatcatcatcatcatcatcgtatgagaagatagagaagagtgagagtatgaga

SEQ ID NO: 753 - DNA, 124 bp, Arabidopsis thaliana
gttgtctggaatagctaaaatgttctcaagtgaaatgactcttgcttctgcttggattcatcttcttgttgtagatcttttcgctgcacggtatattacacttctcttcttctcaatgggttct

SEQ ID NO: 754 - DNA, 61 bp, Arabidopsis thaliana
gaaatgtgtcttgtgtgtgtatgtgtgtgcaggacttgctgcttatatattcacaaacagt

SEQ ID NO: 755 - DNA, 98 bp, Arabidopsis thaliana
tagtgttgacagaagatagagagcacagatgatgagatacaattcggagcatgttctttgcatcttactcctttgtgctctctagccttctgtcatca

SEQ ID NO: 756 - DNA, 61 bp, Arabidopsis thaliana
attgttcaggaggagcggcagtagcagcagtctgctcttcttctggatgaaaatctatagg

SEQ ID NO: 757 - DNA, 63 bp, Arabidopsis thaliana
ttaagtcgttgaagaggacctggaactcgatgttatcgtccgggttttgtccggtttctctaa

SEQ ID NO: 758 - DNA, 134 bp, Arabidopsis thaliana
gtacaatcattttatgcttaaagacttgttccaagccgtatcctatcaaaacactgcaagtctctctctctttcaagccttgtcggtggttgaatcgaaagctatgtctcaggtatttttcatcagtgttgatt

SEQ ID NO: 759 - DNA, 84 bp, Arabidopsis thaliana
gaagcacaacggcgatgatcatcataatcataatcgtaatgatgattatggttttgatgatcatggtttgttgaagaagagaaa

SEQ ID NO: 760 - DNA, 134 bp, Arabidopsis thaliana
gttgaactttatatcttgttggtttgaggtagatgaaaaggtgaagatttaatctgtcttgtgttgaggaatgaattttgattcttagtttttgattagctcactttggtatactgtgtggttgaatccatttg

SEQ ID NO: 761 - DNA, 90 bp, Arabidopsis thaliana
gattttcccaacttcgatattatcattccctgtttgctgcttgagaatatcaatcaaggtctgcagaggaagagatttgtctttggcatg

SEQ ID NO: 762 - DNA, 137 bp, Arabidopsis thaliana
ttatctaaacttactatactctaagtatcagtgtttttacgatttgtagttgatgtttcttagatatatataagtgtgattatgatgttacctatggatttattcattatctttgataccaatgtgactagtttagg

SEQ ID NO: 763 - DNA, 83 bp, Arabidopsis thaliana
atggtgtgtcgatatatagagatagagagagagtgagtgatcacggactctgtctttcttctctatatatatcttcatacttt

SEQ ID NO: 764 - DNA, 72 bp, Arabidopsis thaliana
gaagcggacaatggaagtgggtttgtgtctatgtatgtggaatgcctctcatcgacaacaccacccattgat

SEQ ID NO: 765 - DNA, 88 bp, Arabidopsis thaliana
atcgtctctcatcttgtttttgttgttgacgactgggctttagaagaattaaggagtcagagcaatgagaatgtggacatgagtattt

SEQ ID NO: 766 - DNA, 121 bp, Arabidopsis thaliana
aaaaatggagatatggaaagaagagatgggattggtggaagcagatactggctccatgtttctgtggtattcagctacgtctcttgtttcgctttcgctgccttctctctcccatttacat

SEQ ID NO: 767 - DNA, 82 bp, Arabidopsis thaliana
gagatgatgacggtggtgagatggttctgcgtttgtgtcagcgtcgtgtctcttattattgttattggatagaagaagaaga

SEQ ID NO: 768 - DNA, 68 bp, Arabidopsis thaliana
ataataacgacatgtacatgtgtatgtccatgataatacgtaaggcatacattacatgtcatatatta

SEQ ID NO: 769 - DNA, 82 bp, Arabidopsis thaliana
gaacattatgtcgtggtagtagaggacaaagtttttgcacggttttggttgcgatttggatggttttctagctgatatgacg

SEQ ID NO: 770 - DNA, 85 bp, Arabidopsis thaliana
ggagtcggaagagagggagactccgattgtacggacggtggttgtgagtttaaattcactctctcgtcttgttccggaggagaag

SEQ ID NO: 771 - DNA, 131 bp, Arabidopsis thaliana
ttgttgattcatgtgagaggagatatcaatgtcttggccaagaaacgagaacagagttgttgtagttgttgtagtagcagcgttaacacatgatgatgatctcgggttctgaagaagaagatgatgataat

SEQ ID NO: 772 - DNA, 77 bp, Arabidopsis thaliana
aacgctttcactgtttctgttttggattcttcgattgcttttgagctttcgatttgattccatttcaagctgctgaa

SEQ ID NO: 773 - DNA, 81 bp, Arabidopsis thaliana
cagtgtgtgtgagagtgtatgttcaaaaatctagttactctataagtatgattcaactcaaacacacacacacacacacac

SEQ ID NO: 774 - DNA, 98 bp, Arabidopsis thaliana
gtccatttgattttgtgttgatgatcattgtgaacatctctgtctctctgttcagggacctaaaggagcatctgagaagattacagcagcaatcagat

SEQ ID NO: 775 - DNA, 134 bp, Arabidopsis thaliana
ggtggggatttaagggtttaggtcctataaataggttgtgcaaagttcttcaatacgaattattattgttattggcatgttcatactttgatgatcttagagtaaggatcacaaaaaccttaaattaaactaca

SEQ ID NO: 776 - DNA, 104 bp, Arabidopsis thaliana
catgtatgtgtgtatgtgtgtatgtatgtatgtatggatgtatgtatgtatatgcatccctaattatatatatatatatatatatatatatatatatatatata

SEQ ID NO: 777 - DNA, 119 bp, Arabidopsis thaliana
catttctcacacatccatatatttatgtatacttacgtacgtatctacgagtttttgtgtaaacatgtggatgtgtgtttttaagagcatgctaatccctaaccctacaaatcttcgac

SEQ ID NO: 778 - DNA, 81 bp, Arabidopsis thaliana
gatattggtgcggttcaatcagaaaaccgtactcttttgttttaaagatcggtttatttgattgagccgtgccaatatcac

SEQ ID NO: 779 - DNA, 72 bp, Arabidopsis thaliana
ctcctgatgatgctggagatctgagaatcagtgaacccataacttctgagaagatccagaacggaatcagaa

SEQ ID NO: 780 - DNA, 95 bp, Arabidopsis thaliana
gcttgtttatattgatgggtcattgtaaattcaccttctttatgtagaaattgatcgaatttgtggtggaatgttgaagtaagcttcatggtgtt

SEQ ID NO: 781 - DNA, 135 bp, Arabidopsis thaliana
atttagaatattggacttatgcagagatttcacaacctgttcaaaaatgtttcttgctcttatatatttcttgttctgaaaccacaacaggcgtgggaatcttggtgcgaaaatggaggagttggttttttggat

SEQ ID NO: 782 - DNA, 68 bp, Arabidopsis thaliana
ttgatgaagatcatcatcatcatcctctgcctgttaggaggaagaagatgggaagaatttttttgtct

SEQ ID NO: 783 - DNA, 86 bp, Arabidopsis thaliana
aaatttggtacccttgccatatccaatcagttcggaaaccttgaaattggttttaaattgaagtgcttgaatgtaacagggtgcat

SEQ ID NO: 784 - DNA, 108 bp, Arabidopsis thaliana
tgttttgtgttcattgtgttgttgttcctgattttgttgcagtggcaaatttctagagaatcaagagatttgagctactgtgtgtatgacaaggacatagcaacgggt

SEQ ID NO: 785 - DNA, 135 bp, Arabidopsis thaliana
ttagcaataagataattcataggagttttgaggctagatttgttctttcaatctgaagtttctttctttttgtttgtctgaaatgagcagtgacagctttggttgctgtgaagaatgaattgaatgatccgtaca

SEQ ID NO: 786 - DNA, 118 bp, Arabidopsis thaliana
agaaatcaaaaacaagaactgcctaattgctttgttgaagcagtatatgtatattgtttgtataacatatagtttgattgtttcacatatatcataatggtccaaattgttttggttt

SEQ ID NO: 787 - DNA, 85 bp, Arabidopsis thaliana
atacaacctgattttgtctgtgctttggcgccatccggggaaggttgacttggagagtgtcaaagttgttcactactgtccacct

SEQ ID NO: 788 - DNA, 141 bp, Arabidopsis thaliana
gattggctgagaaaattaccagattcattgctatgtcaggttttcttgaatcttcccacaaaagatgtggttaagactagtgtgttatcaagtacatggggaaatatatggagaagtgtacctggtttggacttggggtat

SEQ ID NO: 789 - DNA, 138 bp, Arabidopsis thaliana
attggtacataaaatgattttcgttgttgttgtgttgatttgcaatttcggagtgtcctcgtgtatatatgtacatatagccgtcaacattttgcaggaagaaacagagaggttaggtcatcaacgttgccaaggctt

SEQ ID NO: 790 - DNA, 128 bp, Arabidopsis thaliana
aatttgttgcttgcgcacgcctctgtttcaagactatataagcaaaattacaaggtacatatagttttgcataacactattcttgaatgtgtgagttgatgacaagagaacaataacatactaaatag

SEQ ID NO: 791 - DNA, 128 bp, Arabidopsis thaliana
caaagaagagcagagatgtttgagaggagctgccacggggataacaattgcgagagatggatgtttgcaatgagatgtgagttatgcgtagcttcgaattcaaatgctgttgtttattgtcctacaca

SEQ ID NO: 792 - DNA, 132 bp, Arabidopsis thaliana
gtatctctgtcttccatattttagatcttcttcagcttcgagaaggttcctgactctgagaagtaagtgctttgagtcccacttcctaatcctaaagcctgctgaggattgcacaactctattccctgtcaa

SEQ ID NO: 793 - DNA, 101 bp, Arabidopsis thaliana
gtcaactttatagtggtttcttgtgtttgttgtaggacttgtttcaactgctgatgggtctgctcttgctaagattggttccactgtaagaacccgcctta

SEQ ID NO: 794 - DNA, 133 bp, Arabidopsis thaliana
catctacctttatccatcggcgactcacttttgtttttctaaaccctaattttctgtctgggtctctctgtctttgacgtatttatagtacaaaaaaaattgttgcccaagaaaaaaaaaaaaaagaaaaaca

SEQ ID NO: 795 - DNA, 79 bp, Arabidopsis thaliana
ttagacgttcaaatgtgtgtgtttgtgactgggaaaatattctctagttataagatattattttttgaacaaataatta

SEQ ID NO: 796 - DNA, 87 bp, Arabidopsis thaliana
gtcacgaccttcttcttcttctgcatctgctgcttcgccgtcgcgaacttcctatgctacaagtgccggtagtgattatggtggtgg

SEQ ID NO: 797 - DNA, 81 bp, Arabidopsis thaliana
caaacaatccaaagttcctctctctctatatctctactttagttgtgccagggagatcagagagtgagagaaagatattga

SEQ ID NO: 798 - DNA, 64 bp, Arabidopsis thaliana
aggtgtagagggaacttgggagatgttgtcagctctctctctgtcttctaggtctataccggtg

SEQ ID NO: 799 - DNA, 80 bp, Arabidopsis thaliana
aaactcgatgacaaatctagacagtgtgtgtttttgggttactcacttacccaaagtgcttatctctgtcttcatcttca

SEQ ID NO: 800 - DNA, 80 bp, Arabidopsis thaliana; identical to SEQ ID NO: 799

SEQ ID NO: 801 - DNA, 95 bp, Arabidopsis thaliana
atttgtttgcaggatatgggctgatgaatgcccaacaagttatcccacagtcgcttgttgtgtgcattggtgcttgtgtttatcttgtaaaaact

SEQ ID NO: 802 - DNA, 95 bp, Arabidopsis thaliana
tctacaagtcaattgggtttttgttgctctctctctcttctcaccttgatatttttcagagagggagagatgatttccgatcattgctatgtcgt

SEQ ID NO: 803 - DNA, 135 bp, Arabidopsis thaliana
cttactctttttttcttactatctttaggctttggaacctccgagtgaaagtgctataaactctgcaattttattgttgcacaaggtaccatgtacttgtattggagataagtctttattttataaaaattatta

SEQ ID NO: 804 - DNA, 93 bp, Arabidopsis thaliana
tattaagtatttgaggctgctgatggtgcaggtgagtgttgggacacttctggcatttacaatggtggcaatatcagtgttgatactaagata

SEQ ID NO: 805 - DNA, 126 bp, Arabidopsis thaliana
aaagcctcacgtcttttcttcttcctatttcttggatcctctgttcttgttctgtttttctttctttggtggttcttgagagattgagagagtgagtgagtgtgagaaatattaagtcagaaggat

SEQ ID NO: 806 - DNA, 73 bp, Arabidopsis thaliana
agatcggtgatagagagaaaatgagagctgagagtaagatcgtcgtcggaatcatcttcttcttcatcgagat

SEQ ID NO: 807 - DNA, 91 bp, Arabidopsis thaliana
ataagtttgatgctgagaggtttaaagaactggagaacaagtggaagataacgtcttgctcttcttcttcgtgccacgctaatgcatcgat

SEQ ID NO: 808 - DNA, 117 bp, Arabidopsis thaliana
ggctccatcctggttgtatttggacagttaattgtcctcattgcttttcttggactggtttaaacaatttgtgattctgaggacaattaattgtccaaatacatatagtttggtttg

SEQ ID NO: 809 - DNA, 91 bp, Arabidopsis thaliana
tgttatgttactctgtgcaatgtttcagctgtatgatgctcagaggaaggtgtgggcgacaaagggtgaggaacaagaggcagggaagaag

SEQ ID NO: 810 - DNA, 91 bp, Arabidopsis thaliana
cgataagtatgatttccttcgatgctgtgagtgtttcttctctgaatttctcattgaattttgtttttgggaaggaagatcttatttctca

SEQ ID NO: 811 - DNA, 90 bp, Arabidopsis thaliana
tttttcatcatcttcgtcttctccattatctctctacccaaatctggcagagaaaaacaaaagaagaagaagaagaaaaactttcgatat

SEQ ID NO: 812 - DNA, 75 bp, Arabidopsis thaliana
gatagagagcgccataatccttcttcttcttcagcgttttcggctgctggagaagaagatggtggtggtatcagt

SEQ ID NO: 813 - DNA, 80 bp, Arabidopsis thaliana
tgcccaattaattagttgccactgtttttgttgtttgcagtctcctacatttattatgagaacagtggtcgatacttggt

SEQ ID NO: 814 - DNA, 102 bp, Arabidopsis thaliana
ggggatggtgatggtggtgatgatgatgatgatgatgattttcaacaagatatttattatcgtgtaaatggttatgattattattataataactatgatgat

SEQ ID NO: 815 - DNA, 77 bp, Arabidopsis thaliana
tgctgctgatagtattgtgcttgttgcaactgtgtgttgtacaatgcctgtggcaagtatatgatcatcatcatcat

SEQ ID NO: 816 - DNA, 87 bp, Arabidopsis thaliana
caacaaatgttggttctgtgtctgcatgtcttcataggcttgacctatagtctagagaagtaaagtattgatgagaaacgagcattt

SEQ ID NO: 817 - DNA, 100 bp, Arabidopsis thaliana
ggttaccaatgatcaaggatcatcgattattgttgttgaagatcttggaaaaactcgaagtcttcaagctctagtcgatggctcaaaagttgctgtgaat

SEQ ID NO: 818 - DNA, 132 bp, Arabidopsis thaliana
ggagaaagagtggatggtggttgtattgacgacaagtactccaggtggaagctttacagctggtgttgctgctggcaaggcgacgtctgtgagagtaatggctggtttagggctaatggggttgttgtttag

SEQ ID NO: 819 - DNA, 102 bp, Arabidopsis thaliana
tcagttctcatggtgagcatgatgatgatgaagatgatactgggtttcagatttcagaactctctgtcactctctttatggctgctctctggagaaatgata

SEQ ID NO: 820 - DNA, 90 bp, Arabidopsis thaliana
agacagaattggagagagagtgttggtttgttgtcaatggagtacctatagggtactcaattagagagcatgcattgttgacctgtttga

SEQ ID NO: 821 - DNA, 90 bp, Arabidopsis thaliana
gtgaaagcatacttataaaaatcatatatgtgtgactgtgtgcatgtatcttctcatgttataatgcacattcatgcatatatgtatgta

SEQ ID NO: 822 - DNA, 91 bp, Arabidopsis thaliana
gagacaaaaacagagaagaagactaactctctcctctgtgtctcgcttcttgagtgttgtataagagagagagagagagagaggaagtgat

SEQ ID NO: 823 - DNA, 63 bp, Arabidopsis thaliana
tcatagtgattgtgaggtggtggctctgatgctttgcttcgcaatgtctaaatcaacttatcc

SEQ ID NO: 824 - DNA, 145 bp, Arabidopsis thaliana
agaaggtaaatatatttgttcaattgtcgtagcaaatgttagaagttttatgttgaagaagaagtttttttttttttttaaatatattgttctgtttcttgtgtgtatatatgactctaatacaaacatttcttcaaataatgac

SEQ ID NO: 825 - DNA, 85 bp, Arabidopsis thaliana
gaatgatgatggtagtgtgatgataatgattgttgtatgatagttattagttattaatattaattattatttagattataagaaa

SEQ ID NO: 826 - DNA, 87 bp, Arabidopsis thaliana
ccaactctctctcactttctctgtttctaggtgcaacttattgtctatgtagagatggtgttggagagaaagatcttcaaacatcga

SEQ ID NO: 827 - DNA, 102 bp, Arabidopsis thaliana
cacataaggttctactcactggctcactataccaaaacaacattaaggaggttttcaacattcttgatgttgttttccctgagtttctgaagcataaccgaa

SEQ ID NO: 828 - DNA, 77 bp, Arabidopsis thaliana
gagagagtttggttatcttgggaaaagaggaactagggtttttctttgattctaagaccaagaagaagatgatatag

SEQ ID NO: 829 - DNA, 142 bp, Arabidopsis thaliana
aatctgacagaaagagcagtgagcacgcaagagaagcaagtgcaatgatatgcaaattgcctttgtgtgctcactctcttctgtcagtttctttgcgtttctcttgtcccaactctttcattcacaattagtccaacttcag

SEQ ID NO: 830 - DNA, 220 bp, Arabidopsis thaliana
aagacacaaagtttccttataaacacagtacaaatcacaagtttagccatcttctatgtacagtagttttccaataggtcgagcatgtgctgaaactgtgtgtacagagttctcataaacacacagtttcagcatatgctggatctacttgaagactactgttcttataaggtactgaacttgttatctgtactgcgtatatacgagatctctgtattct

SEQ ID NO: 831 - DNA, 122 bp, Arabidopsis thaliana
ccgaaatttggcaagagagaactatgagatgatgaggtttgactgatctttgcattgatgtttactttaccagctgtagtcttcattgtcaacaaattcaagcagagaaacaagagagagat

SEQ ID NO: 832 - DNA, 104 bp, Arabidopsis thaliana
ggtatcggtatggtgaaactggactagttgggcggctctcgggttgcgatgagctagtgcttgctgttgctgttgggtcctcacagaatctcgcttcgtccgag

SEQ ID NO: 833 - DNA, 111 bp, Arabidopsis thaliana
ttttcggggatgctttgggcggtccagcaggtggagcagcactctgtgaagctggtgtaccaccaccaccaccagcagtggctccagcagacccgtctgaagagtaacctc

SEQ ID NO: 834 - DNA, 122 bp, Arabidopsis thaliana
tgattccatcgactcgttcaagcaccagctcgaagaagcttagctaatttatcttagaaaataatgaaaaagctatgcttctcaagaaggtgcatgaacaagttgatgtatattttgatgtg

SEQ ID NO: 835 - DNA, 84 bp, Arabidopsis thaliana
atgttacatttcttatttgtgattgattcttgaaaccgacatacacgttcatgatgacaggtactcgtatgagtcagttgcaag

SEQ ID NO: 836 - DNA, 126 bp, Arabidopsis thaliana
tcagaactcagaagtaggatatttatgttaatcaatctttagatttcagatgctgttgtgaatgtgatcttgttgtattcataacattggttttgtgttgtgatatgttaaattgctttgtttctt

SEQ ID NO: 837 - DNA, 121 bp, Arabidopsis thaliana
aaacattcgagctgtaagtttttaaagctcacttgatgtcactcatttggtttctgtttgatgatgaaatgtgtaatgcaaactctttcaggttgctcagtatgcttcagatgatggtttc

SEQ ID NO: 838 - DNA, 133 bp, Arabidopsis thaliana
actatttacttttcattattgtcttttattagttttattgttttttcttatagctagattttcctttgtgatttgcttgttcgccaaggtgtattcctatttaacgaagacctatgagtttaatagagatcat

SEQ ID NO: 839 - DNA, 100 bp, Arabidopsis thaliana
ttctatggagattggtgtgaaacagaggattcttacatcgtcatcttcgtcgttgtattggccaagatctatgtagtttgtgaaaccggatttgaatgga

SEQ ID NO: 840 - DNA, 78 bp, Arabidopsis thaliana
catcatcatcctcatcttcatcatcgacatcatcatccaagtagcttagattgaacttctccgatggtggaggaggtc

SEQ ID NO: 841 - DNA, 72 bp, Arabidopsis thaliana
agttccagagccgagggctttgctcgttcatggtatatccacccgggcaaggaaacgcggtttctggttctc

SEQ ID NO: 842 - DNA, 138 bp, Arabidopsis thaliana
agttcaattgttttatgtggggtatgtgaatagaagaacattgtagtatactttatacatttttatttgttttctgttcgtttaaaatgtaactatgtctctttgtgtcagaatttgaaccgataaaagattgcaagg

SEQ ID NO: 843 - DNA, 79 bp, Arabidopsis thaliana
gtatagtgctgacgcagctggtggtgatgcttctgttgagctgactaggcgatgcaggcatgctgctgctgcagtgggt

SEQ ID NO: 844 - DNA, 128 bp, Arabidopsis thaliana
gtagagagatcacgttatctttgcaacgaatttcatattttccacgttactttattattggttgacttttcaagcttttagtattttggtatatgaggaagttgtccggatatcaaaaccaaaagact

SEQ ID NO: 845 - DNA, 79 bp, Arabidopsis thaliana
aatacgctggtctcacaaatcttatctccctaaatagtcgagatgagtgtgtgagtgtccacgaataattcatattata

SEQ ID NO: 846 - DNA, 121 bp, Arabidopsis thaliana
cgaagctcattgtgatcagtgtagattgtacttgaattgtgtgttagtgaactttggattgtgaattttgaaagcaatgtgtgtgtcattttgctatggattatgattctagcttgggttt

SEQ ID NO: 847 - DNA, 135 bp, Arabidopsis thaliana
aaatataagcaaaacataaggaaatgtatatttatgtgtgcttttttttttggcaaagtatttatgtgtgtctatgatagatagatgagataatctgagcggcatatcataactttccttttgacatgtctagaa

SEQ ID NO: 848 - DNA, 104 bp, Arabidopsis thaliana
ttcttttgtttacagtctcgtgcagtgcacaactcagtaatggagcttcggaatatttgcaatcatccatatcttagccaactgcattcagaggaggtaatggt

SEQ ID NO: 849 - DNA, 118 bp, Arabidopsis thaliana
taacgtccctagatagatactaaaattttgtgaaatttgacaatgatgaatcatgcaggggttcataacgttgtcgtgtttgatagcggtttcggttaacttcagtacgtttttagtg

SEQ ID NO: 850 - DNA, 104 bp, Arabidopsis thaliana
tgaatgggttcagactggagctagtgacttgcatgtcagatggttcatcgttgttctctgatgatatgttgatgcttgttgagtctgatgttgataaattgctg

SEQ ID NO: 851 - DNA, 79 bp, Arabidopsis thaliana
aagtggcggtgacgtgttggtcagtggtgaagaaacggtggcttggccgtggatagtagcacttgctcgtcgccatttc

SEQ ID NO: 852 - DNA, 89 bp, Arabidopsis thaliana
aactcttcctttgcagaagaagaagaagaagaaccattatctaattcacagagctcttcatcttcatcttcatcttcggaactagagtc

SEQ ID NO: 853 - DNA, 110 bp, Arabidopsis thaliana
atgctattgctagacgggagaaagacgaggtggaggaggaggaggagttgttgggaaacagtccttttcttttgtaccttgtgccatctcagtctaaagcttctcaggtt

SEQ ID NO: 854 - DNA, 96 bp, Arabidopsis thaliana
aaaatattgaatgagatctactactttgtttgttgagaagagtctctgctgtgcgtctcttagctgaacctttctccaagactttgtaaatttcat

SEQ ID NO: 855 - DNA, 123 bp, Arabidopsis thaliana
cgttattgttgttctggagaatgttagctgtggttccgccgagtccaacgaggaaagggacattgttgttgttgacaatcccattgttgttgttgtttgacggaactccgttgcttacaggaa

SEQ ID NO: 856 - DNA, 70 bp, Arabidopsis thaliana
aagtttgagaagatgaagaagattcttcacttcttcttggtgaagttttgtttcttcattagcttttgct

SEQ ID NO: 857 - DNA, 88 bp, Arabidopsis thaliana
agagagaaagagagatagtttgtcttttttctctggtttcttagagagataaagagagtaatagagagagagggagttgcagggggaa

SEQ ID NO: 858 - DNA, 134 bp, Arabidopsis thaliana
taaggctgttactaagtttactagctcttaggtttagccgtttaggtttcgaatcttggttcgttttgatatggaatctgatggtttttatgtaatttgttgaagattgtaatggtgttaatgttttcttttta

SEQ ID NO: 859 - DNA, 141 bp, Arabidopsis thaliana
ttgcatgtttagtcgtcgcccagaacaacaacaacaacaacgaaaagagcaaaagcctagatgatgttgttgttgttgatcgtgaggcaggtgatgttagctcctccaaattcagaaaacatagaagatcaataaaccttg

SEQ ID NO: 860 - DNA, 97 bp, Arabidopsis thaliana
gattgttgttgttgttctcttgtcgccattggtgaagtgaaaacacttcatgttcttcttcttccccaaatccgaccgagtcaacgaaaataaaaat

SEQ ID NO: 861 - DNA, 89 bp, Arabidopsis thaliana
tctgaacacattattgatggaggagaagtggaagctgtcgaagaaagacacaacagcttcttcttcctcctctaagtcaaagttttcta

SEQ ID NO: 862 - DNA, 73 bp, Arabidopsis thaliana
ctacgaccgtcaatgtatgattggctatggtgaagaagagttcgtcattgagtgcagcattgattaatcgtag

SEQ ID NO: 863 - DNA, 108 bp, Arabidopsis thaliana
gaatttggtggagttaataagggtaatgggtttggtggtgatgatgaggagtttaggaaagatccagcttacttgtcttattactatgctaatatgaagttgaatccg

SEQ ID NO: 864 - DNA, 87 bp, Arabidopsis thaliana
ctggaaaacctggtgcttctgcttctgagtgggatgctaatggattgattggtttgggacttggaggcaagcagaagagttttgctg

SEQ ID NO: 865 - DNA, 122 bp, Arabidopsis thaliana
ccatacactcatcagcgttctcaacaagctggtgcacagatagtgttgcgttgtaaggctccacaacagtgtcagacaccttaggcgatgggaacacagagaaagtcatcatcatacggtct

SEQ ID NO: 866 - DNA, 83 bp, Arabidopsis thaliana
gggccatgttggtttgtcgggttgtagcgggtcgggtcgggtgtgatttgattgatgatgatgacgtggataagagtgatggt

SEQ ID NO: 867 - DNA, 102 bp, Arabidopsis thaliana
cttcgaaacgactgagttttgatcggtctagatgatgatgatgatgatttccatagctcacatgacttgggtcgatgaagcttcgtcgacggagttccgaaa

SEQ ID NO: 868 - DNA, 76 bp, Arabidopsis thaliana
attctcttcttcttcttgaggtttcttgtttgcagcgccgccattagagccctcgtcggaagtttcagagattaca

SEQ ID NO: 869 - DNA, 106 bp, Arabidopsis thaliana
agctgttttcggacatttcgtgacgaatctgcctgcgtttcacaagattctagtgtttgtatgtgtgaagtcagttcaggttccttatgttggagaagaagagagg

SEQ ID NO: 870 - DNA, 78 bp, Arabidopsis thaliana
cctgagcatgctgttggagcagaggatgaggaaggttggttgatttatgctactgctggagctgcggctggtgggtta

SEQ ID NO: 871 - DNA, 129 bp, Arabidopsis thaliana
cattgttaatccattcttaggtaggcaagttttcactatttggttgtgtgtacatgatgtttattaatatatatgaacacaaaataaaataacaaatatataaaacctgcccacactatcaaatggact

SEQ ID NO: 872 - DNA, 96 bp, Arabidopsis thaliana
agatgatggcaagtgttttgggatgcattgctttcaaaccactttggtattttggggaatgctttgttcgatcgccgcacttctcgccgccgtttt

SEQ ID NO: 873 - DNA, 112 bp, Arabidopsis thaliana
ctcgttcatcaccaattttcttgtacatgattgattaagtgtgtaagcatctttttcgattaatgatgatgatgttaattggagaaacaaatttttcataaattcccttata

SEQ ID NO: 874 - DNA, 100 bp, Arabidopsis thaliana
atgttgtgatatatggatcggggtaagtgcttttgttggggtggatttgcttgtgagagtttgctgcaattgttggattttgagctatatatggggtaaa

SEQ ID NO: 875 - DNA, 91 bp, Arabidopsis thaliana
gtttttagtgtctttgtctttggttatatagatgttgatggcttgtgggtttggaaatattgtaggtgaaggcaagagattttatgaagaa

SEQ ID NO: 876 - DNA, 123 bp, Arabidopsis thaliana
gaaatatgaagatacaatgtgatgtgtgtgagaaagctccggccacgcttatatgttgtgctgatgaagctgctctctgcgctaaatgtgacgttgaggttcatgctgctaataaactcgcta

SEQ ID NO: 877 - DNA, 124 bp, Arabidopsis thaliana
atcgaatacatcaattatttaaaacaagaatgatagaattcaaagaaaataagtttgcaatgttgatgattctaagatcataatttggaccaaacgaaagttcttgaaacttcttcttctggtg

SEQ ID NO: 878 - DNA, 79 bp, Arabidopsis thaliana
gatgtctgtgcttgttgattgttgtaaggaactgtaaggttataaaattcttgcaaatatcatgtagcatagaatcttc

SEQ ID NO: 879 - DNA, 133 bp, Arabidopsis thaliana
gttttattctgttgcatttgtttttaaggaattaacgggtccaatctaaaacacatactatttcttttgttgttgcaaaataatgaaactgtgtttttcggttgatgtttgaaaaccaagtaaccaacactca

SEQ ID NO: 880 - DNA, 71 bp, Arabidopsis thaliana
caagctcctggagtgatgataacagatcaggataagcttctaagtgatattgttgttgaagtctttccaga

SEQ ID NO: 881 - DNA, 124 bp, Arabidopsis thaliana
acggattatgcgagagaattgtagtcttcggtggcatggtgttgaaaatggtgacactctttttgtgtttaaagggtctattagtcgtgaaggtttctgagatttttaaaatttaagcttcgta

SEQ ID NO: 882 - DNA, 103 bp, Arabidopsis thaliana
tgcacaggtgtatatatctgtagacgaagtgtgtgtgtttgtgaacgcaattaatacgacatttgtttattctttattcacttgaaaccaaaaagctcatttt

SEQ ID NO: 883 - DNA, 134 bp, Arabidopsis thaliana
gaagctgaaagattgaagctgatctctgagggctgtgatccgaaaaccgtgagtgttatgtgtttctgtttgattcattttagtcaattttggtttgagtatgtacaagttttgattggtgtttttctgtttta

SEQ ID NO: 884 - DNA, 383 bp, Arabidopsis thaliana
tttgaaccattcgtaagctataactagaagattaaatacggtagaataatgaatgtattatgggaaaaatgttaaaaaaatcgccaacttttaaaaatgggacaaaaaaatcgccaactcctgaaatgtcatttaaatcatatacttttggttgacttttccagaaagataataaagcaaagattcgtaatcaacaaaactttgctctgttatctttctaaagaactcaatcaaaagtatgtgattaaaacgacatttcaggagttggtgatttttcatcccatttttcaaagttggcaatttttttgacattttttccaatgtattattgagtgtagctacatgaagtatgaaccatttatcttgacatagcattgcgtact

SEQ ID NO: 885 - DNA, 69 bp, Arabidopsis thaliana
tccttcttcgttaccaccgacttctgcttctcctaatccaccgtcaaagcagaagatgaagaagaagca

SEQ ID NO: 886 - DNA, 99 bp, Arabidopsis thaliana
ttcgtctttgagactgtttgtttttgtttttcatgtccagtttgcttcaaaggttgcttttggttgtgacatgttgtaggacgtttctgaactgtttca

SEQ ID NO: 887 - DNA, 104 bp, Arabidopsis thaliana
aaaaactcttctaacatttgttgattgtgtgtcctttggcaggtatttgatggccacggtggcacagatgcagcacactttgttagaaagaacattctgagatt

SEQ ID NO: 888 - DNA, 83 bp, Arabidopsis thaliana
atctctctgccttgagaatcggaaaaggtgttcattgtcatgcagtggtttctgggtttggattggatacttacgttcaggct

SEQ ID NO: 889 - DNA, 83 bp, Arabidopsis thaliana
tggaacttagatgaacgtatgggcagagcaagaaggtgattaatgagttgctgtttcttgttatcatcatcagcatcaatttc

SEQ ID NO: 890 - DNA, 83 bp, Arabidopsis thaliana
agcagagagacagaaaaacagaacaagagatttggtgactgaatgaatgattaaagggtttttgcttgctctgtgtctctgta

SEQ ID NO: 891 - DNA, 89 bp, Arabidopsis thaliana
tactaaatacactaataactaaaatacattatctacatcaattcgtagcatatactttgcgttgatgatgatgatgatgatgatgataa

SEQ ID NO: 892 - DNA, 123 bp, Arabidopsis thaliana
aattagtgttgttgaagtgatcaaagttcttgttgttgttgaagtgatcaaagttcttgttgtttgcaagagtccagatatatatagataataattattgttgttgaagtgatcatattcttg

SEQ ID NO: 893 - DNA, 81 bp, Arabidopsis thaliana
acttcaatggggagcacctagctttgatgctggtcatgcttttgctatgatggccgctgttttagtctcactcattgaggt

SEQ ID NO: 894 - DNA, 116 bp, Arabidopsis thaliana
aagcattacagggcgaatcctctattggcagtggaagttgatgacccttatatgttattttctcatcattttcctctgccaaaggagatttgcctcgcaatgcttcactaacgtta

SEQ ID NO: 895 - DNA, 113 bp, Arabidopsis thaliana
aatatgcattacagggcaagatcaccattggcagagatctattacttcattcttgcatcatatgcataaatgtttgtggtgagctctctgccaaaggagatttgcccggtaat

SEQ ID NO: 896 - DNA, 80 bp, Arabidopsis thaliana
gatatggattcatatggatggcgacgtcaggagtgatcccacggcctcccgtggctatgatgtgtttgttcatgttcttc

SEQ ID NO: 897 - DNA, 103 bp, Arabidopsis thaliana
cttctcctggccatagtaccaacgcttgtcatgttcttggctatgccttttgtaagagtttatgaaacggtgaccattagtgacaagaaacacttggatggtc

SEQ ID NO: 898 - DNA, 99 bp, Arabidopsis thaliana
atccttatatgtttttaacttttttgtctttcacttttggtgtgacttcttcaatcggattttgatgttgcattgttgagagttttggtgataaggaat

SEQ ID NO: 899 - DNA, 77 bp, Arabidopsis thaliana
tttcgggcagtgagggaaagctgggaagtgtagtgtccttttaaacaaaatcctcccagctgttctttttgttccac

SEQ ID NO: 900 - DNA, 78 bp, Arabidopsis thaliana
cggagcacgtccttcatcatcatcatcttcacggattagctggcgagggagatcggatgaggaagggagagagcgact

SEQ ID NO: 901 - DNA, 127 bp, Arabidopsis thaliana
gaagaagaagaccagagagagaagagcaataggagctgcataataatctggagttactgttgatggtggttgtgaatacagtagagcgagaattatcttcctttttctttgttttgtcgacgcatga

SEQ ID NO: 902 - DNA, 117 bp, Arabidopsis thaliana
gtgtatgtagttgtgtgtgcatagctttatctgaaactgttgatgaatgtctctgttatttttttagttttggagggtttgaagtatgcaaattcacatgagtgggttaaacatgaa

SEQ ID NO: 903 - DNA, 71 bp, Arabidopsis thaliana
aaagcttcgtcttgaagaacgatttcccgatctcggaggaggaggaagatcgtgtcttcttgctcggagac

SEQ ID NO: 904 - DNA, 98 bp, Arabidopsis thaliana
aacactacttgtgaaagactcaagatctgtttcatcaccaattcgatcttgctgctgcatcattgagacgacaaaaaatcttgaatctttctcacaat

SEQ ID NO: 905 - DNA, 67 bp, Arabidopsis thaliana
gtagtgtgatgaatgacttgacaacattgttgctgttgatgatgttgttcaggtggtggatcacacg

SEQ ID NO: 906 - DNA, 73 bp, Arabidopsis thaliana
atctctctgtcaaatctttcttgttcttcatgtgttcttgtgatgcgaagaggataatatgattgtgcagaga

SEQ ID NO: 907 - DNA, 83 bp, Arabidopsis thaliana
cgagaagtttaaggtatgttgatgtagagcacaagtttttcaagtttgtgtagatctagatctagatatatttggtatttcag

SEQ ID NO: 908 - DNA, 72 bp, Arabidopsis thaliana
actctgtctgatgttgttgctgctgctggcttctccattgtttcagttgcaaatccattgaagaaagagaga

SEQ ID NO: 909 - DNA, 108 bp, Arabidopsis thaliana
ctacatgaatgctgaacagtttgaagctgcacttgatgtttttgttgaaatgccgaaaagggtggcatttgcttggaatataatgatctcagggcatgctcactgtgg

SEQ ID NO: 910 - DNA, 95 bp, Arabidopsis thaliana
aaacactttataacttattcacatagagcgcttgcaagagaccattctaagctaagtgtttgtgcttgagtcttagaaaactgaatttcatatcg

SEQ ID NO: 911 - DNA, 96 bp, Arabidopsis thaliana
taactccgtataagcaactgtgagtgtgtctgtgcgtgatgtgaaatctgacgttgactcacagcaagctcatccaacggtgtatgaagatcttat

SEQ ID NO: 912 - DNA, 73 bp, Arabidopsis thaliana
aacaacaagacaagtgagactgagagtgacagagagaggtggatctctgggttactgtgtctatgtgtcctgc

SEQ ID NO: 913 - DNA, 134 bp, Arabidopsis thaliana
tcacaacccaaaaaaacaaagtagagaagaatctgtaaagctcaggagggatagcgccatgatgatcacattcgttatctattttttggcgctatccatcctgagtttcattggctcttcttactacaatgaaa

SEQ ID NO: 914 - DNA, 77 bp, Arabidopsis thaliana
tcagtgactaatgttgttgttgacgttgattctaaaaattctgttgccgacgttggttctcaaagttcagttgctga

SEQ ID NO: 915 - DNA, 135 bp, Arabidopsis thaliana
tatatatgttgcatttaggagggtttttctaggtgttgattgcttaatctcgttgcattgacttgtgttgttgttaccttagatttttaattagggttatttaatttcatctgaaaaagtttatagaagtttaaa

SEQ ID NO: 916 - DNA, 78 bp, Arabidopsis thaliana
atcaaattatgtgggtgagatggaggcatggatgtgtttgttaggctcatacctgaggcctcgtatgtttggcctatt

SEQ ID NO: 917 - DNA, 96 bp, Arabidopsis thaliana
attatatatgtatgcctggctccctgtatgccatatgctgagcccatcgagtatcgatgacctccgtggatggcgtatgaggagccatgcatatcc

SEQ ID NO: 918 - DNA, 132 bp, Arabidopsis thaliana
agcatagacatcgttgaaaggcaatttgatagacgtgcttgaaatttcgagagtgacggtgttggtgctgatgaggaccaccgttatgaggaggaaagccgcggtcaaaaccctaaggagaaggagcactgt

SEQ ID NO: 919 - DNA, 76 bp, Arabidopsis thaliana
attttcaggaaaaggagttagagcatcatcaagatgaaggcactcattcttgttggaggcttcggcactcgcttga

SEQ ID NO: 920 - DNA, 144 bp, Arabidopsis thaliana
caagtagacatcaaaaagttgaaaagagctgtgatggacaagaaaaagtcggtatctggttcctcttcatcgtcctcttcgtcgttggatcatatttttggtccaagagtctctcactcgtattcttcatcaacaacaggattg

SEQ ID NO: 921 - DNA, 71 bp, Arabidopsis thaliana
acgattaaccgcaggaacagagctaccactagagtacattggtgctcttcctcttgatggtgaacatgatt

SEQ ID NO: 922 - DNA, 74 bp, Arabidopsis thaliana
catctggaccatctgattttgttgttgttgttgttgagggaaaaaaccataactagggcataacatagaggtcc

SEQ ID NO: 923 - DNA, 81 bp, Arabidopsis thaliana
gaagaggatgatgtatgtaggagactcgttaaaccgtggaatgtttgtatcaatgatttgtcttcttcatcgtcttattcc

SEQ ID NO: 924 - DNA, 91 bp, Arabidopsis thaliana
ccctattttttttgctgtttagagttgactgtggagttgagttttactttcttttgctcactttgcttttatgtcttagtatgctgataga

SEQ ID NO: 925 - DNA, 99 bp, Arabidopsis thaliana
gatctgacagttctaactcatcatgcttcggaggaggactgtgctagagcagtgtgttgtgtgcttgaagctgaaatgggaaattcagatctccaagta

SEQ ID NO: 926 - DNA, 148 bp, Arabidopsis thaliana
aacaaaggagatcatgaacagttcaggaggttcttgttcgtctttaatggatgtggtggcttatgatcatcatcttcatcatggtcatgatgaagagcttcatgttttagctgtagatgataatcttattgaccgtaaactcgttgag

SEQ ID NO: 927 - DNA, 115 bp, Arabidopsis thaliana
aaccaaattgatgagaagtagtactggtttcaccacaatagtagtgattttgatgatcatcaaacatcatcgtctcttgccaaaccaatgacaagtcctcacctgtcgaagagcc

SEQ ID NO: 928 - DNA, 198 bp, Arabidopsis thaliana
agatatagaaggagattctttcagtccagtcatggatagaaaaagaagagggtagaaatatctgccgactcatccatccaaacactcgtggtagagaaacgataaatttaaaccgcagtgactgtgtgaatgatgcgggagatatttttgatccttctttatctgtgtttggactgaagggagctccttctttttcta

SEQ ID NO: 929 - DNA, 76 bp, Arabidopsis thaliana
cgagggtcggtttggtccagaagaagctattcgatgttgccacgattgcttatctgcactttcttcatcctcttca

SEQ ID NO: 930 - DNA, 89 bp, Arabidopsis thaliana
tgagctccaggacatgatcaacgaagcggatgcagatggtgacggaaccatcagtttctctgagtttgtgtgtgtaatgactggtaaaa

SEQ ID NO: 931 - DNA, 78 bp, Arabidopsis thaliana
gctcagaagaattaccgcaaggtcaggacatattaatggttctaacgttgacaagaattttttgagtgttgataagcc

SEQ ID NO: 932 - DNA, 128 bp, Arabidopsis thaliana
gtttttgtgtttggttttcttcttctgttgatatgtgtttatgtaatcacaaaagtatgttgtttggttagtcggagacagagtaagaagacatcagacacatgaaatttgaaacaaaaaggaaaaat

SEQ ID NO: 933 - DNA, 78 bp, Arabidopsis thaliana
ttttaagctcagtaccagcatcttcgacgtttgcatcctctgatgcttttgatgaagattctggttgacggttcttgt

SEQ ID NO: 934 - DNA, 74 bp, Arabidopsis thaliana
acttactcacacggtgtgtgtgtgcatgatgtgtaattgtgtattatacactctagaagaagaaagttttattt

SEQ ID NO: 935 - DNA, 86 bp, Arabidopsis thaliana
cattgccatgattctgcttcttgttcctctcatgtgttttctctacatgttccacaagagaagtaaccgaagagaatttcgcaccg

SEQ ID NO: 936 - DNA, 124 bp, Arabidopsis thaliana
gagagagagagagacgctgtgtataaaagaggcgacgtgttgttaaaaaagttaaaaataaaataaaaaaataaacctaaaatgtgctttactgttacagtacgtgactttcttgagattttct

SEQ ID NO: 937 - DNA, 90 bp, Arabidopsis thaliana
atctctgttttattgctgcttctgcttcctcttccattactcgtcttaaaacaaaggagaaagagtcaagagacatgcatgcgaagacag

SEQ ID NO: 938 - DNA, 83 bp, Arabidopsis thaliana
aaatgtgttgttgttgttgcactgtgcaggggatgctggtgagggacttgaacttgcaggcagggaacgatcttagcggagtg

SEQ ID NO: 939 - DNA, 93 bp, Arabidopsis thaliana
tgccattgtaatgcacaagttcgatatctgaaaataaacaacacgtttggtcatgaatgtatgtgttgtgtgtttgaacttggagtaaaataa

SEQ ID NO: 940 - DNA, 68 bp, Arabidopsis thaliana
agtgagtgtagtgtttggattggaggctccattttggcttctctaagcacctttcaccaggtaaataa

SEQ ID NO: 941 - DNA, 128 bp, Arabidopsis thaliana
aattttctttgctttcttctcctttggtcctttctttaaacccgagacagttaggtttgtgtgagagagagaatgatgagtaaaaccctttctgtctgagtaagaggaaaccaacatggagatgggtt

SEQ ID NO: 942 - DNA, 85 bp, Arabidopsis thaliana
cgacgtcatgatgttcttaagatcagagttttgctccgtttgacaattcgaagtggttagatgatgatgatggagatcatgagat

SEQ ID NO: 943 - DNA, 123 bp, Arabidopsis thaliana
gagaaggtggaaagagtgagagttaaggataatgcatttgttggaagatctgtgaatattgatttggttgatgatactgcgttgtttgatgttgttcctttctacaagaaaggtaaagatcat

SEQ ID NO: 944 - DNA, 98 bp, Arabidopsis thaliana
acacatcagattttaatgcccaaatttctctcattttcttgcttcgaaaccaaatattcaaagagagcgagagagagagatagatcaagaaagaaaga

SEQ ID NO: 945 - DNA, 130 bp, Arabidopsis thaliana
attggttcaatttctagattgtacatctcttgattgtagttgttgggagggtaaaagttatgatgttggctgatcttttccatgctcatatccattaagacttgagtgtccgatagtagaacaatacttc

SEQ ID NO: 946 - DNA, 135 bp, Arabidopsis thaliana
caagatgaagttgctggaaatgcctttgatgcagtccggaactattgttttcatttcccttgtatagttgtgtatgcaatgttttattgtctgtttcatctttcttttcacttgtgactgtaattaaaaagttga

SEQ ID NO: 947 - DNA, 131 bp, Arabidopsis thaliana
ggaacagagctcatggcggagagagcttcttcttcgtcgtcatcgttttcgtcacggtggttgttgttgatgatatccatggcgaaagattgaggaaagagaagaggaagagagaatgagagaaatgggga

SEQ ID NO: 948 - DNA, 132 bp, Arabidopsis thaliana
tcagaacaagtttttgtttgttaatcatggtgagcaatctctgatttttccttggggttctgattttgttgagaggagccttttcctagcaaggagttcaactgaatagacggtcttggactagtagcatca

SEQ ID NO: 949 - DNA, 69 bp, Arabidopsis thaliana
aaggaatcagattgttgatgctgttgtgatcgctaggatccttggagcttctttagttgttcctgtttt

SEQ ID NO: 950 - DNA, 104 bp, Arabidopsis thaliana
cagtcttctcttccttcctgttttcatgtctggtcttcttctacaccgtgtctctaatgataatcagcaacaactcgtagaagaagccggattaacaaattctg

SEQ ID NO: 951 - DNA, 100 bp, Arabidopsis thaliana
tcaggatgaccttcctccccgttatgctgatgttgatgttcgtcattcaagaccccgtctggactatgatgttggcccatctcaatatggggaatcctac

SEQ ID NO: 952 - DNA, 138 bp, Arabidopsis thaliana
gaagcactacaacaaccacctcaacttccaattcccctgttttcttctacatatttacttgattggtttgtgttcttgagttgtgtatttgaagagactttgagtcaaatagtacttttgttttgttctgccaacaag

SEQ ID NO: 953 - DNA, 141 bp, Arabidopsis thaliana
atttgcacaatatatcataatgttatcatcataatgatagctatcatgactatagtatgttgatatgatgatgatgaagatagtatgatgatgatggtgatgataatatgatattatgagagggtaatgatgatgataata

SEQ ID NO: 954 - DNA, 82 bp, Arabidopsis thaliana
gagaacaacggttgtgaatcttgtgatgatgatgattcttccgacagagatttatctggtcatgatatatgggacacagccg

SEQ ID NO: 955 - DNA, 61 bp, Arabidopsis thaliana
agagatgaacactgaggagagaagagacgcttcatcttcttcgtcctcatccccatcatct

SEQ ID NO: 956 - DNA, 87 bp, Arabidopsis thaliana
agtattttgtgcctttctgtcatatgactaaattggtgaatgctgaatcctaattcatgttgttggttgttatgaagagtttacgaa

SEQ ID NO: 957 - DNA, 84 bp, Arabidopsis thaliana
aaagagtaaatgctgcttgtagtagatgggtttcttcctttgccttgttcgaaggtgtggattttgtttgttaccaatgtagta

SEQ ID NO: 958 - DNA, 71 bp, Arabidopsis thaliana
agattctgagaaggagcagatcaagacactcatcgtctctcttatgctctctgcttctcctcgtatccaga

SEQ ID NO: 959 - DNA, 108 bp, Arabidopsis thaliana
tttgtatcgccgtcgtgctgtgtctagtgttcatgagtgttgaagttgttggtgggattaaagccaatagtttagctatattaaccgatgcagctcatttgctctctg

SEQ ID NO: 960 - DNA, 134 bp, Arabidopsis thaliana
gagagaacattgtgaggtttcgtagttttatgtaaagacgatgtgaacatgcattgtagtttcatggttggtttggctttggatttcatttgcgtcttaggagtaaaatgaatgcaactatttaggtacttggc

SEQ ID NO: 961 - DNA, 97 bp, Arabidopsis thaliana
tttaaattctcaggtaaatttgtgtatgtgcttgggtttagatgataggagttgggcccaaactaaacccacaaagaccttttgctatgactcacac

SEQ ID NO: 962 - DNA, 90 bp, Arabidopsis thaliana
tttatctcgtatctaatcactttcaacatttaagacacacacaaaacatatgtatatatattgtgtgcatgcgtttgtgtgtgagcttgt

SEQ ID NO: 963 - DNA, 106 bp, Arabidopsis thaliana
cagatctgtcttcgatttcgaatcgatctcttttgattttggtgattttaagatttagatgttgctttaatttgggaatcgtaaacaagatctacatgtctacttt

SEQ ID NO: 964 - DNA, 97 bp, Arabidopsis thaliana
gagacatgaggggaggcttgacggcgctgcacatggcggctggttacgtgaggccggaggtggtggaggcgctggtggagctgggagctgatattga

SEQ ID NO: 965 - DNA, 130 bp, Arabidopsis thaliana
aaacaaggtatgtctcttaattctcccatatcatctcatctcatatctttgtgttcatttgcttgatgttctgtgcttatgcagttgtttcagatgttctgatgctatgatattaatcgtattctcattt

SEQ ID NO: 966 - DNA, 96 bp, Arabidopsis thaliana
aataaaacttgctctgacctctatagtatcatggatcacttctgatattagttctgtgtggtactatttgtatgtgagagttgctttgtagatgtt

SEQ ID NO: 967 - DNA, 119 bp, Arabidopsis thaliana
tgcgggtgagaatctccatgttggagaagcagggcacgtgcaaaccaacaaacacgaaatccgtctcatttgcttatttgcacgtacttaacttctccaacatgagctcttcacccatt

SEQ ID NO: 968 - DNA, 85 bp, Arabidopsis thaliana
aatccttctagttcacttgctggttcacgtctcaaggctatggcacttgactgtgaaatggttggtggtggtgctgatgggacta

SEQ ID NO: 969 - DNA, 131 bp, Arabidopsis thaliana
ccaatgatacaggttaagattcgaaatgattttgatccagttctctctcccgagagctctttgtttgtattgaagagcaataaacaagtaagggttaaaatataatcacattctgaacttccttaatttac

SEQ ID NO: 970 - DNA, 125 bp, Arabidopsis thaliana
acatcaacccatcatcacctaatatcatgatcatcatcaccctcatacgtacattgctccttttgtgtgtgtgtgtgtgtatcgtttttatggtgttttcaatataataaatgggggtttacatg

SEQ ID NO: 971 - DNA, 87 bp, Arabidopsis thaliana
gatgatctagcgaatcctccattggcaggccatgaaacttgtttccctgaaccattgcaatgagaccgcttttgatctcaaatttgt

SEQ ID NO: 972 - DNA, 106 bp, Arabidopsis thaliana
cgtccatgttacctccaccgtcttcttcttttttcaccatcatcatcttatctttagagattgatgatgatgaagaagaagtcccgtggttggacaatcgaccttg

SEQ ID NO: 973 - DNA, 103 bp, Arabidopsis thaliana
caactctccctctctcatactttttttttgaattattaatttttttgttgagtatctcattgagatactcaaatgaagatgatctaaggattttgttgtatgg

SEQ ID NO: 974 - DNA, 133 bp, Arabidopsis thaliana
gctagtccattttgttgaggagtgtgaggatatgagatgtgttgttgtatcccatgattctgaagatgttgcagaaacttatgattgacaaactctccaccaccatcacattgaaacacactaatcttatgat

SEQ ID NO: 975 - DNA, 71 bp, Arabidopsis thaliana
aacccaacatcagaaatcttgctgaccatgtgctggtcaagtaatatgttagctggtttcaagtcgcggtg

SEQ ID NO: 976 - DNA, 152 bp, Arabidopsis thaliana
accagtggatgtgagccaactattcttagtttgtatgttccaagtttggtctacatgtaatctctctctcttttgtgtgagtctgtgtgtttttaaaatttatcttgctttgaactgatatttcattaagatgttgtattgtcagatgtttc

SEQ ID NO: 977 - DNA, 134 bp, Arabidopsis thaliana
agacctaatgaaccgattagggtttggatctgtgtgtatgggttacagtgtttgttccatgtggttttggtttggtctgagtattggagaagaaactcaactcgtagagctagggatttggagtcttatgatca

SEQ ID NO: 978 - DNA, 120 bp, Arabidopsis thaliana
aacttgaaagcgtctaggactttgctgggccgaaactggtgtcgatcgacactaggagtgtgtcgatcgacactcctcttgattcgtgaaaccaaagtcgtccttaccttactttttctt

SEQ ID NO: 979 - DNA, 97 bp, Arabidopsis thaliana
gcttaggaacgaacccttgactttggttgtaagtaacaaacggtttgggttggttctgctgcagctgctgttgagggtaaacttggtcctgaggatt

SEQ ID NO: 980 - DNA, 66 bp, Arabidopsis thaliana
taggccgaaactggtgtcgatcgtcaccagaagtgtgttgatcgacactctgcctgaatctggaat

SEQ ID NO: 981 - DNA, 87 bp, Arabidopsis thaliana
atggaaatgtggaactgagtggatatgctgtttttgtctgttaaacagagaagctggctgttatccactgagaagcgaacgaaacag

SEQ ID NO: 982 - DNA, 93 bp, Arabidopsis thaliana
aactccaaatagatgtatctttattccttggattgaaaacttacctcaatgcttttgttccttgactcctcagagaatagagaaaggacatca

SEQ ID NO: 983 - DNA, 128 bp, Arabidopsis thaliana
tcgaccagatactcgaccacctagttgtcgggcaacagactgtgtagtcgagtatctttgtcagtgtctttgctgtttactcgacctgtcactcgaccacacccagtgcttggcagcaagctgtgttg

SEQ ID NO: 984 - DNA, 72 bp, Arabidopsis thaliana
tgttggttttgaagttgttataccctttgtagccactttggttgttgttgatgtagctgacttcttccaact

SEQ ID NO: 985 - DNA, 85 bp, Arabidopsis thaliana
atttgcttgcgtgactggattgccctgtggtgagttttctgaggattatgatccagatgatgatgcagtttatgttgttggcatg

SEQ ID NO: 986 - DNA, 78 bp, Arabidopsis thaliana
attcccttgttgtggttgttgttgttgcatttgtcggtgatggaatcgcttctgcttctgcaacgactgaaccgaact

SEQ ID NO: 987 - DNA, 68 bp, Arabidopsis thaliana
ccgtatgagtctttgtctgtgtgtcttctaacaaggatatactacttaggcttttaagatcgggttgc

SEQ ID NO: 988 - DNA, 107 bp, Arabidopsis thaliana
ttgaaactgctgctttggaacaaaccctaggctttggttgtaaggaacaaacggtttggttggttctgctgctgctgctgctgagggtagacttggtcctgagggtt

SEQ ID NO: 989 - DNA, 126 bp, Arabidopsis thaliana
actctgttcctgggtgattttttcttctcgagtagatagtggtgtttgtataacatcttcatcatctttcttggtctcttttggaacatgtaaaccaaaacatcaaagcaaattttttcttttttt

SEQ ID NO: 990 - DNA, 142 bp, Arabidopsis thaliana
aaggtaaaggaagcaaaggacgatttcagttccagattcagcgagagtgtcgatcgatacactcctggtgtcgatcgatcgacacctgtttcggcccagcaaagtccattacgctttcaagtttacagaagaggaaatttgc

SEQ ID NO: 991 - DNA, 81 bp, Arabidopsis thaliana
taagtccctttcttttgcttgattttgctcccagcaatggtaaagcagctttgttttggggtttagctaaaggtggacgtc

SEQ ID NO: 992 - DNA, 61 bp, Arabidopsis thaliana
actgagagagattatcttgtgttggaagatcttcagaggcaaggtaattttggtttgagat

SEQ ID NO: 993 - DNA, 121 bp, Arabidopsis thaliana
gaattttcttttggtcaattttgaattcgggttttcgtgatttgtttttgttttatagttttaaaatcttgatgatgaagcattatgatatgcagaatcttcagttccgaagagttgttct

SEQ ID NO: 994 - DNA, 116 bp, Arabidopsis thaliana
tctgagtgtgcaagttccataagtgtgatgcatcacgtctgcatcttacatttgagtcttgtagatgttgcagatgctcactaatacaaggaaaaatgagaagtagtcagagacag

SEQ ID NO: 995 - DNA, 111 bp, Arabidopsis thaliana
attcccattatttacacagcagcacttgcaaaaacaaaaaatagaatgagtatatctagtttcatgtgtttgtttatgcaagaatgtgtttaaaatcagattcagagacca

SEQ ID NO: 996 - DNA, 162 bp, Arabidopsis thaliana
atttggttgtacttgttaggatttgaacttggttgtacttgttaggatttgaatttggaatgtttggttttaggatttgaatttggtatgcttggttttggatttcaatttgctttgtttggatttgaatttggtatgcttttttttggatttcaatttaga

SEQ ID NO: 997 - DNA, 98 bp, Arabidopsis thaliana
tgtttgatgcaacatacgttggtgatggtgcccatgatgtttgcgacaagatctgcttcttcatggtgatgatggtcacaacaagttatgttaatctt

SEQ ID NO: 998 - DNA, 84 bp, Arabidopsis thaliana
gaaagaggagtaaattgagaaggagagagaggaagagagagcccaagataagtaaccatatctccattttcagtttgttctcta

SEQ ID NO: 999 - DNA, 78 bp, Arabidopsis thaliana
aaagatggagaaatcagaacaagcaatgaatgtgattatcgctcacgttggtgatgttgttctgaggaaaattgacca

SEQ ID NO: 1000 - DNA, 110 bp, Arabidopsis thaliana
cgaacataattacagagacgagagactggtttggtgactcatgcattcatctctaatgatcttgatggatcatgaaatcatcaagattcaagtcctcctaaaaataaatt

SEQ ID NO: 1001 - DNA, 92 bp, Arabidopsis thaliana
tacaaggacatggcatgcttggttaggtcatgtaagttttggtgttatgattaagatgctggaaaagaacctgaagaagatgatgtcatggc

SEQ ID NO: 1002 - DNA, 63 bp, Arabidopsis thaliana
tggtgtcgatcgacaccaagagtgtgtcgatcaacactcctcttgattcctaaatccaaaatc

SEQ ID NO: 1003 - DNA, 65 bp, Arabidopsis thaliana
gttttagttgagaaggtgattgtggatttggtcttgttaatcatttgtcccgatgcagcttctta

SEQ ID NO: 1004 - DNA, 137 bp, Arabidopsis thaliana
ctcaatttcgttgttaatggaggttagtgttgctgcggattttgatttcgtgtgttcatgttgattgattgattgatttggctcatcttgtatctggtagttcgtgctgtggtgtttgtcttcaggcgaaatgttca

SEQ ID NO: 1005 - DNA, 83 bp, Arabidopsis thaliana
aggggacagcaacactctcttaagcaaagttttgaaattgctctatctctctctaatttgctacctgtatgttgttgctccag

SEQ ID NO: 1006 - DNA, 75 bp, Arabidopsis thaliana
gctctaaaactctcagaacgaagatttggtgtcgaatctacaacaaccgcatcatcttcttcttcctgagtggtc

SEQ ID NO: 1007 - DNA, 134 bp, Arabidopsis thaliana
tttgtgtgttatctcatactatcaggggggcaaatgactgcagcaatagcagggggagttgctgcaggtgcagcacttctatttgctgttccagccattgcgtttgcttggtggctcagaagaaaaccacagga

SEQ ID NO: 1008 - DNA, 125 bp, Arabidopsis thaliana
ctccattcatgtttatttttgtcttgcttcgtgattcttcgtgtttatgccatagtctggttttgatgttattggaagtttctagaatcggtatagtggaaagtttgatgtgacgagatgcagga

SEQ ID NO: 1009 - DNA, 76 bp, Arabidopsis thaliana
attaccaaccataactgaatcagacccagcataagacttggtttgttgcaggtggcgtggtgaatttgttatgtga

SEQ ID NO: 1010 - DNA, 81 bp, Arabidopsis thaliana
aacatatttcttttcatgcagatgatgttgttgtctctggaatcttgacttcaaaatggtctcatgacttgaaagatgttc

SEQ ID NO: 1011 - DNA, 108 bp, Arabidopsis thaliana
catttgagaaggcatctattatatgaactatcatagatgggctagagtatttaaatacatatagctttggtttttatacttcgatgaacttatcaaacatgatcttac

SEQ ID NO: 1012 - DNA, 75 bp, Arabidopsis thaliana
gagcaggcgggtttctttggtagtaagagaggcctgagacaaggttgtgctctctctccatacttgtttgttata

SEQ ID NO: 1013 - DNA, 86 bp, Arabidopsis thaliana
ctagaaagaagatgaaatttgttgagctttgctttggaaagatgtatggtttaggtagtgtggaggttgttcttctttctgattca

SEQ ID NO: 1014 - DNA, 139 bp, Arabidopsis thaliana
ctggtgagttatttcttcacaacttttaaaaaattagtcttgcttagcttctatagtttctagtgaaatgttttgttgaagttgttgagcttgtatgttgttgaattgtgttggttaaagattgagttagttagtcctc

SEQ ID NO: 1015 - DNA, 89 bp, Arabidopsis thaliana
gatggttagagctgttgatgcagatggtgatggattggttaatatggaagagttcatcaaaatgatgtcttccaacaatgtctaaccat

SEQ ID NO: 1016 - DNA, 94 bp, Arabidopsis thaliana
tcagggatcaagtgtgaatgtcttgagatcatgtgtgatgttgttcaaaaatatggaagtttaatgacggatgatcacgagaagctattgaata

SEQ ID NO: 1017 - DNA, 106 bp, Arabidopsis thaliana
cgtggaactctctttacatcattgagatgcatcgaattcagttaccaagttcaatcctatgtttgagattcttgctgatgtaggaactagggagcttctccatgtt

SEQ ID NO: 1018 - DNA, 87 bp, Arabidopsis thaliana
ctgacgaaactgaacccggtttgtacgtatggaccgcgtcgttggaatccaaaagaaccaggttcgtacgtacactgttcatcgatg

SEQ ID NO: 1019 - DNA, 134 bp, Arabidopsis thaliana
tcggttatctgctagtttagattgggtttgatcttaggttgattttggtttggttccaggtttggttggtgtaattggactagagacccaaagataattattggatgggcctattctgaaaataacctaataaa

SEQ ID NO: 1020 - DNA, 122 bp, Arabidopsis thaliana
ccaaaatgcccttgacgaaactgaacccggtttgtacgtacggaccgcgtcgttggaatccaagagaaccgggttcgtacgtacactgttcatcgacgagaaatgcattaaatgatttctgg

SEQ ID NO: 1021 - DNA, 89 bp, Arabidopsis thaliana
gctatatcattattcattggcctggtgtatatgagggttttcctaaaagagaggttacaagatgctgatgatgatgatgaagctgatag

SEQ ID NO: 1022 - DNA, 119 bp, Arabidopsis thaliana
ttgaagttgacgttggttgcgagtcctgtgtttggtggtgataagaagtttttgattgaatcttgtggtgaaatgttgcttgttgatatgtacttgagcttagaggcagtggaagggga

SEQ ID NO: 1023 - DNA, 117 bp, Arabidopsis thaliana
tgcattgttggtttttgtggcatgattgtgggtgtagaatggtataaacgtatctgaagatagagagagtgcattgttgttggtttatgtgacatgctatagaatggtgtaaatgta

SEQ ID NO: 1024 - DNA, 107 bp, Arabidopsis thaliana
aatatgctaatgcgcttcaaaatggcactgttgcagcgattgttgatgaacgtccttatattgatctcttcctctcagattactgtaagtttgccatcagaggccaa

SEQ ID NO: 1025 - DNA, 104 bp, Arabidopsis thaliana
cttttcaggagctcttgtctttttttctttaatctttgattatgttacaaaacaattatgttttttgaagcttgatctgatgtgggttctttgatttcgttcca

SEQ ID NO: 1026 - DNA, 110 bp, Arabidopsis thaliana
ggaagaaacgtaggaatggtagtagaagagtgttggtgatgttgatgacgatgagcttgatctttcatctccgccgtagaagcatgaccacaccggtcacatctcaccgg

SEQ ID NO: 1027 - DNA, 84 bp, Arabidopsis thaliana
tcaccgtgcatagggaagagaggaagcgtacgtcgatgttccagataagcatcgccaccacattcttcttcttcttgatgacct

SEQ ID NO: 1028 - DNA, 109 bp, Arabidopsis thaliana
acacgtgtaaccaccagagccggacttgttgttgttgttgttgccgctttcttggtcggcttgatgatgatgatgctgatgctgtggcggctccatgtgtgtttgattc

SEQ ID NO: 1029 - DNA, 127 bp, Arabidopsis thaliana
gaagttaaactaaattgtctttgttcatctgacttagtgtttgaggagcttaaagatttgtgttgctcttgctctgtaattgtcttcaggttgaatatgatccaaggataattggttatcgtcagct

SEQ ID NO: 1030 - DNA, 83 bp, Arabidopsis thaliana
tataatatatgtaggcgaatgtacacatgttgtaaggttcatttagtttcttcatgtatgtacatgtacatgtgtattgtgta

SEQ ID NO: 1031 - DNA, 140 bp, Arabidopsis thaliana
ctgtctgctttgcctctgcaattgacgcagcgaacaagagaaacgagttcagaaagtgacgttgatgctgatgctgctgaaagtgacgttgttgatgctgctgaaagtgaacaagagaaatggtgggaatgtgagatatg

SEQ ID NO: 1032 - DNA, 130 bp, Arabidopsis thaliana
ttgtaaattccagcaaaagaaacgatgttgatgctgctgaaagtgacgttgattgagttgatggagatgttgttaacggagaagcaagcacaacagtgaaaggtgagagttgtgtcgttggaaaagtctc

SEQ ID NO: 1033 - DNA, 100 bp, Arabidopsis thaliana
cccacagtccgttaacagtttctacatcttcttggtcactctctttcttatggggctgaccataacttggtgtggaccagccattaactctccaatctta

SEQ ID NO: 1034 - DNA, 88 bp, Arabidopsis thaliana
atgcgctttggttatgtggtgttgcagctggaagattttagtgtcaatgccatctggagaagtcgtagatcctccttattctttaaaa

SEQ ID NO: 1035 - DNA, 127 bp, Arabidopsis thaliana
gtatgaatgaaaaaagggttgttatgtatattgattgtctgtggatttgagaaagttgtgtatgtgttattgcagtgtaattgtggaagccttgaagatggatagtttacagaggctttgttcttct

SEQ ID NO: 1036 - DNA, 124 bp, Arabidopsis thaliana
agcgtttcatccaagcaacctcactatcaataaattgtttacaaagacagtttatcatctgttgttgttggcgcttgattttgatccctgcttgttgaatcgaagtgctttcatttgattttag

SEQ ID NO: 1037 - DNA, 95 bp, Arabidopsis thaliana
ctctatacacatcatccacacatatgcttgtatattgtatgagaatatgaatgcatattttgtatgtatgcatgtgtgcatgtgtttgtgtcctt

SEQ ID NO: 1038 - DNA, 97 bp, Arabidopsis thaliana
gaggaggtagttctgatgaactggagtatgaagatgaagatgactaaactaaagcttttcttattaaatggaccggtaactctcaggcgaactctct

SEQ ID NO: 1039 - DNA, 109 bp, Arabidopsis thaliana
tttcaaattttctctatggtaaaaatcgaaactttatgatgattgttgtgttaagtctctctttcgtgtgttgtattgtatcaatagttatcgtgcatcgattgtggag

SEQ ID NO: 1040 - DNA, 91 bp, Arabidopsis thaliana
aggagacaagaagagagtaagcacgcagagctttcgagcatgagcatgctagaaaaagagccatgtgtgctcactctcttctgtcgccttc

SEQ ID NO: 1041 - DNA, 140 bp, Arabidopsis thaliana
ttgttatggggaattctggtgattttgatgtatgttttcacttacattcttatgtttgaagatcttttttttttttttggcaaagatgtttgaagatctatgatttacaatttagctagatatgtgattttcttatgcac

SEQ ID NO: 1042 - DNA, 125 bp, Arabidopsis thaliana
atgattaatttgctttaaggttttttaagttcatgtaatcgtccgtaatgttgacatctgtatgtaaatatgtcttcttagcccgatggtgacgtgaggaactttcttgaagggacatgaaatca

SEQ ID NO: 1043 - DNA, 76 bp, Arabidopsis thaliana
agcttttgatcaagaacaactggagggagaagaccacgcaagtaatgagtgtctctctctttctcagtgaaagcaa

SEQ ID NO: 1044 - DNA, 74 bp, Arabidopsis thaliana
aggatattaggattggtcttcttggtgcaagtggctacactggtgctgaggtttgtgcaatgttgaatctgtct

SEQ ID NO: 1045 - DNA, 135 bp, Arabidopsis thaliana
tgaaagtctacacccttctccgagtgtcctaaggaggtttaaaatttccgaaacaccaattgtgattgtttgagaactcattgctatgccaccaatcgacattgtttcgtcttcttgatcattggaagccataga

SEQ ID NO: 1046 - DNA, 83 bp, Arabidopsis thaliana
aaaaggcttgtagtttctgaaatggaggctagatatgggagaacactccaaattttcttcaacaggaaacgacaggaactcct

SEQ ID NO: 1047 - DNA, 83 bp, Arabidopsis thaliana
tctttggaatttccggtaatccactaggccaagaagacaactcgtcttgttcttcagtggcttcctttggtctcctcgacgat

SEQ ID NO: 1048 - DNA, 84 bp, Arabidopsis thaliana
ggttaaaaggtgtgtgtatgtggtcattggtcagagagctgccatcattgctcgtcttgtggcctcctgcttcatctctgctgc

SEQ ID NO: 1049 - DNA, 103 bp, Arabidopsis thaliana
agagaaaagggaatgtttttttgcaagtgagtgagagagagcgtcactgtgtgaatgcgattcttcttagttcttacaagcaaatctaaacttgtgttttcaa

SEQ ID NO: 1050 - DNA, 69 bp, Arabidopsis thaliana
atgatgatcatcttcttcctgggtttgttgtcgtggatctcaaacttggagattatgaagagattatga

SEQ ID NO: 1051 - DNA, 81 bp, Arabidopsis thaliana
acataagcaagaagaagaagattcacaagaaagaagcagagaagagtgctctgttctttgacttgaatagctctttttctt

SEQ ID NO: 1052 - DNA, 82 bp, Arabidopsis thaliana
aggtgcatcttctagagcaacgattatcgagtcagaaggccacactgtcttgttgtgatgttgtgactgaagagtatgtaga

SEQ ID NO: 1053 - DNA, 135 bp, Arabidopsis thaliana
ggcaacaatatctctcgattctacttcaggtttgttgttttatacgacgcgcaagagtttacggttttggtttttgataccagcatcacaacgaagtagatttgatagagatagtcgaaacgtgtgaccgtgtcc

SEQ ID NO: 1054 - DNA, 127 bp, Arabidopsis thaliana
tattgaggtacttttatctgctaggcattctgcattcataccattttcttcgtgatgtgtgtacatgatgaaggaatagttggctctttttttgtgattcataatgcttttgtttagaggattggga

SEQ ID NO: 1055 - DNA, 98 bp, Arabidopsis thaliana
tcggtactcggagtttcgaaaaatgcaaccaaagctgagattaaaagcggtatgtttctgtttttctgtgtgtgagagattcccttgtatatatagat

SEQ ID NO: 1056 - DNA, 107 bp, Arabidopsis thaliana
gtattgtagccttatttacctttttgtggatctctctctgtgtctgtgaattggattcagatacgatggagactgtgaaaggagtgcttggtagatggggaaagagg

SEQ ID NO: 1057 - DNA, 173 bp, Arabidopsis thaliana
taaataagaatgagagtaatatagttgaatcttcgaaagtatttcaagaagtcagctgagctttctcgtcatcacttattagtaaatatagtctctatatttttgatgagtgatgattggaaatttcgttgactcattactcttgatgattctgctatgttgctgctcattat

SEQ ID NO: 1058 - DNA, 90 bp, Arabidopsis thaliana
aaccatgtataaatctatgtatatagatattgtggtatgatatgtttaagccgtcaatgtcatatttatatagaaatatgtgggtaccat

SEQ ID NO: 1059 - DNA, 125 bp, Arabidopsis thaliana
aaatggctcgaacaaaaccttcaaggtctctccttttgaatccatgtctctttatataggtgtttgtttctaaaaagttgagatctttgaggtttgatctattttttgttttggatatgaatttg

SEQ ID NO: 1060 - DNA, 107 bp, Arabidopsis thaliana
ctttgtttaagtatcatcaatccgtgattacactgtgcttctggtaatctagtgtgtatgtgcaaatgatgcaggaggtgattcaaagacattgatgtttgtgcaaa

SEQ ID NO: 1061 - DNA, 98 bp, Arabidopsis thaliana
atatttctaagtgattgtatgattttggtgatgttcaggtacaatgcttgttggcttcctttgcttgttaaatactctgagtcatcatcggttagtga

SEQ ID NO: 1062 - DNA, 84 bp, Arabidopsis thaliana
gctttagctgtttgagtagcaacagtgagacgcaaggtccatggaagaccactccctctatctctttgtagatgttcagataga

SEQ ID NO: 1063 - DNA, 157 bp, Arabidopsis thaliana
tcaaaatgggtaacccaacccaacccaactcataatcaaatgagtttatgattaaatgagttatgggttgacccaactcattttgttaaatgagttgggtctaacccataactcatttcatttgatgggttgagttgttaaatgggttaaccattta

SEQ ID NO: 1064 - DNA, 95 bp, Arabidopsis thaliana
accgcagtaaactcaaccagtctctctcttttccttcggtatctaccagaaatcaagaggaaaacatcagtaacagagggagttgagtgttctta

SEQ ID NO: 1065 - DNA, 97 bp, Arabidopsis thaliana
tgaactgtgaagggcaatgttctttcttgtggcattccttttatcttttgccgacaaagattcccaccatataaaggaacttggtgtttcatcaagt

SEQ ID NO: 1066 - DNA, 92 bp, Arabidopsis thaliana
atccttcctttggttttgtttctcacatgatcatcatcattatatctcaggttctaagtggtgttgctctagtgtcttacagagctgcaaat

SEQ ID NO: 1067 - DNA, 123 bp, Arabidopsis thaliana
tactcaaggagatcttgccaagcgccttgacccattctatctacctaatctctttgatgggtttgaagatagtaaatacggattgcttgttgatgatgttgtgagactttgtaagctgaaacg

SEQ ID NO: 1068 - DNA, 129 bp, Arabidopsis thaliana
ctctctctcagtggatcaatgatgagctaagaagggacaattttgagccagaggtaactttgttgttgttactgccacgtatttgtttaatgtatctttttaacacagttttgaccataccattacaca

SEQ ID NO: 1069 - DNA, 66 bp, Arabidopsis thaliana
tagagagcggttgcgattggtgtttgtgatgagatcttctataggcaggaacccaagtgctcttga

SEQ ID NO: 1070 - DNA, 98 bp, Arabidopsis thaliana
atcagatttaatttcgactatgtatgtatgtgtgtgaacattttgaaaaatgtgtaaccagaagtcaaaaagtcaaaatatatagataaattagttgt

SEQ ID NO: 1071 - DNA, 96 bp, Arabidopsis thaliana
atggtagctttgggttaaaggaatcgaagaaactgtaaaagttagggttttgcattgaatttgcattgtttcttgatccacaaattcaacgcacca

SEQ ID NO: 1072 - DNA, 126 bp, Arabidopsis thaliana
catgacaagaagcccaagaaaaagagctattcaagtcaaagaacagagcactcttctctgcttctttcttgtgaatcttcttcttcttgcttatgtgtacaactgactaaaatgcatcaactcgtg

SEQ ID NO: 1073 - DNA, 107 bp, Arabidopsis thaliana
gaccaaaatttaattgattgcaaaattaggtttgtaattgtttgagatcagatagaaaaaggtccatctttaagcgataatatcctcaaaactattttgtcatcagt

SEQ ID NO: 1074 - DNA, 97 bp, Arabidopsis thaliana
tatttacttatagtccctaacatgacatacttatatttttgaataggtatacttattaattgtgtaagtgtgtgtgtatatatagactcacctcatt

SEQ ID NO: 1075 - DNA, 135 bp, Arabidopsis thaliana
gtatagtgaactattggtagcatcgtgaccatgtggtaattaacaatctttgtccttcaaatttatatatatggaggttgtggtctatatgatttgttaaagtgaaaagacaactggttttctattaatttggtc

SEQ ID NO: 1076 - DNA, 99 bp, Arabidopsis thaliana
tcttgggttgatgatcccatcactcgtcatattatcagcctttgcttaaccgaagaagatgatgatgatgatgatgaaaggaacattctctggcctatt

SEQ ID NO: 1077 - DNA, 70 bp, Arabidopsis thaliana
attatgatttttgacggtgtgaggctggtgatgatgtttcatatctttgcctacattgcctgatcaaagc

SEQ ID NO: 1078 - DNA, 122 bp, Arabidopsis thaliana
ttgggtttggtgaagatacatgtcagagcgatttgaatctgattggagagattataagtgatttggtaatgtggagagatgttgcgaaatcgactctctggtttggttttggatgtttgtct

SEQ ID NO: 1079 - DNA, 75 bp, Arabidopsis thaliana
ggtggtgatggtggtggtgctgacgttgtgatgatggtggtgacttagctttgtgatggtgatgacatagggatg

SEQ ID NO: 1080 - DNA, 87 bp, Arabidopsis thaliana
tcttactctaattttgattctcattgccccatcaaaatctggcaaatttttgcttatagatgttgatggtgattcaatttggggaat

SEQ ID NO: 1081 - DNA, 113 bp, Arabidopsis thaliana
gtcgtgcacattgatggactaaaagatgtaaagaaagcttttggttgttgactgtatatcatcttttcttgtgtttgttaatggctgaggttagatattgaatattttgtagg

SEQ ID NO: 1082 - DNA, 90 bp, Arabidopsis thaliana
atgcgtaggaggaagccgaccagcggtgctggtggaggaggtgcctctggtggtgcagccggatccatgcttcagttctacaccgatgac

SEQ ID NO: 1083 - DNA, 94 bp, Arabidopsis thaliana
agaagaagagagaacagaggagcaaaaaatgagaaaccctagatttgaaattcgtctcgttgtctctctctgtcacacatcgaaaccaattaga

SEQ ID NO: 1084 - DNA, 112 bp, Arabidopsis thaliana
gaggacaaagagttatcaagatgttatttacaagaacaagtttcttatcaaggacaaaattgttcttgatgttggagctggaactggaatcttgtctctcttctgtgctaaa

SEQ ID NO: 1085 - DNA, 139 bp, Arabidopsis thaliana
aaaggaggtaagggaatagcaataacgaaggcgacagaagagagtgagcacacatggctctttttctagcatgctcatgctcgaaagctctgcgtgcttactctcttcttgtctcctgctctctccctctctacgtcta

SEQ ID NO: 1086 - DNA, 77 bp, Arabidopsis thaliana
ataatatgaagcagaaaggtaatgatgcaaatagttctcacattgcatctctagttgatgctgcttcatcgtccaga

SEQ ID NO: 1087 - DNA, 68 bp, Arabidopsis thaliana
aattcacaacctctagcctctcttcctcattattattgaatgatggtgactttggtgatgatggagac

SEQ ID NO: 1088 - DNA, 85 bp, Arabidopsis thaliana
gctaaataatttctttcaggattgctgtttacaaggctctttaccggctttttggaggctttgttgctgatgttgttgctgcaat

SEQ ID NO: 1089 - DNA, 107 bp, Arabidopsis thaliana
attaataactaatttgaaacaaataaaacaccttgcatatacgcatatatgagtgtatgtatatgcatgttaaagcatatacgtacggagctcatagatatgaagaa

SEQ ID NO: 1090 - DNA, 89 bp, Arabidopsis thaliana
aaaagtgagtcaaaagcagtgaatgtgtgtctctcttggatagatctatcttggggagtgaacagacaattaaattaaatcatttataa

SEQ ID NO: 1091 - DNA, 93 bp, Arabidopsis thaliana
ctaatgattactaaataaaatttaacccttgttttagcatggttgtgatctggtttccacatttccatgttaatactataacacgtgtttagg

SEQ ID NO: 1092 - DNA, 101 bp, Arabidopsis thaliana
gtgattgttctgttgtaattcatgaattttccaaagaaacttgtgtgaataattgtatgatgttgttgattgatttgtgagggtagaagaacgatgattgg

SEQ ID NO: 1093 - DNA, 105 bp, Arabidopsis thaliana
caatcttcactgtgttttttttctgtacattcagcaatttgaacctttttacatgtctatgtgaatgtgatatttttgataggtatttgaagaagaagaagattc

SEQ ID NO: 1094 - DNA, 87 bp, Arabidopsis thaliana
attggtttttagttctgattatgatattgtctttgagcaggtgactctatcagggattctgaatttcattgatggtttatggtcgag

SEQ ID NO: 1095 - DNA, 91 bp, Arabidopsis thaliana
tgatgatgaagatgtgtgtgttgatgatgatgatactaattctcatgaattcacttcatttattgtttgcattgcatttacgttatcgaag

SEQ ID NO: 1096 - DNA, 90 bp, Arabidopsis thaliana
cctcgatcgctgctgtgctaggatgagatcttgattgtaagcttatagatcttacatggttcttgatcatcatcatcaccatattggttt

SEQ ID NO: 1097 - DNA, 80 bp, Arabidopsis thaliana
ctagaaatttaccaccagatttcgtgtctgctgctgctgctgatactgctggtggtcccatcatccttttgctattacta

SEQ ID NO: 1098 - DNA, 96 bp, Arabidopsis thaliana
agtatactggttcatgtctacgtggcgttgtatatattgggatgcatctagaacatagatatgtttgataaattaaagccatataaaccatgtaaa

SEQ ID NO: 1099 - DNA, 83 bp, Arabidopsis thaliana
ctcttttattacataaatttttgtgtatatacacacactcatgtgttcatatgtacatacatgtttatgtacttacagattca

SEQ ID NO: 1100 - DNA, 71 bp, Arabidopsis thaliana
atctgcatctgaaacaattgttcctgctgcatctcatactcctgatgcatctgcatctgaaacaattgttc

SEQ ID NO: 1101 - DNA, 128 bp, Arabidopsis thaliana
gttttagtatgaggttggttgttgtattttttttttctttgttagtaaaccgcttgttgtatatatatgaaggtgaaagcaaagagtgggatcataaacttgtgttatagaaactttatgaaatagaa

SEQ ID NO: 1102 - DNA, 93 bp, Arabidopsis thaliana
ctctcagccatcaggttcttggcttgagatccttttcctgacttcttcttgtactttggatcatcttcatcatcaatctggtcgctgcaatcc

SEQ ID NO: 1103 - DNA, 131 bp, Arabidopsis thaliana
tagttattcgaagttgaaactaaagcaaacttatgtgttttgtatgccttttggaacttgtgtttggttgtgtttacatttacttgtttgttttctaaacagtttattacttttggatgttatgcaacatt

SEQ ID NO: 1104 - DNA, 130 bp, Arabidopsis thaliana
tagtatgcacatacgtgatgatattgggaaagatggcgagggagtcgaagaccatacttatgatgatgataaggaatcgagtgaggaagttgattgtttccagatgcaagagaacaatgatagtgatgat

SEQ ID NO: 1105 - DNA, 79 bp, Arabidopsis thaliana
gcttgagcttcatctcatcgtcgtcttccaccactaacgaaggcgaagacgaagaagatggtggaactggagtaatctc

SEQ ID NO: 1106 - DNA, 92 bp, Arabidopsis thaliana
ccaatctatttcacttgagttactggattgttctatctgttcatgtctagattggtgctaagtagctctttgaagcagaaaatttagttcaa

SEQ ID NO: 1107 - DNA, 110 bp, Arabidopsis thaliana
gctagtaatgttagtgcatgagttcgatgtcagctacttgattggtgttcagatgatgatgttgttgtaggtgaaggagaattctgctctgctaaacaaatgtacaagat

SEQ ID NO: 1108 - DNA, 88 bp, Arabidopsis thaliana
tggaggagttgttggagttggtggagctggtgtagcggttggtggtgaagtcggagcttgaccagtaacgccggcgatgaggacgata

SEQ ID NO: 1109 - DNA, 98 bp, Arabidopsis thaliana
gaattattgagaacgtacattgctgctgaagaagtgttgatcttgtttttgtaccaagtttggagcattgctcgtgtaagtaatgaagttcttttaag

SEQ ID NO: 1110 - DNA, 139 bp, Arabidopsis thaliana
gataaagtgtgattgtggaatcatggcaaggaagagaggatgatctaggaactcgtttgttttatgtttggtgtttttggttattggaacccggttaggattgtcagttattcttggttttgttgatcgaattatttat

SEQ ID NO: 1111 - DNA, 126 bp, Arabidopsis thaliana
ttcaagatagagaaaagaatgatggtttaaaactattgtaagagtctgtttttcgatgatctagttttgattattatcgacacatttttatatagttaatatttcgtcaataacgttttcattttt

SEQ ID NO: 1112 - DNA, 129 bp, Arabidopsis thaliana
ggtatcttagaagatgttccagtgaaaattggagaatgcttgattcctacagacttcatggttttggaatttgaagaagaacctccagatcctcttatactgggtagatctttcttatctattgctagt

SEQ ID NO: 1113 - DNA, 129 bp, Arabidopsis thaliana
gggttttagttttgttttagcaaagtttgtttggttttgatttcattagttttgattttattttggttttaaaataaaaaacaaaatatgaaataatgaattaatatgattatatttgttttagtacat

SEQ ID NO: 1114 - DNA, 95 bp, Arabidopsis thaliana
aatgctatctgtgatgatgaagatataagggctgtttcttttgttggctccaacacggtaagtacttttttttttatgttgctcttttatagcct

SEQ ID NO: 1115 - DNA, 103 bp, Arabidopsis thaliana
tcaacaagtttgttctctccagctacaacttcaatgctgggatcttccttatgttataccagaactttgtctcggtgatcattgtggttggtttgagtttaat

SEQ ID NO: 1116 - DNA, 132 bp, Arabidopsis thaliana
ttgcccgtgaagtagctgttgtagcatttgtttcatatcagcgtcagcagcagcaggaccttggctttgctgaggtgcaaaccctggtggtggtggttgctggtaatttccctggaattgctgcttaggaac

SEQ ID NO: 1117 - DNA, 131 bp, Arabidopsis thaliana
ttgttgttgttgaagaagaagaactgaagaagtaacaatggcggatctgagacagtaagaaagaagaaagagcggcagttgctttttttttaatctttttttctctttgataattacgcttcagaaataaa

SEQ ID NO: 1118 - DNA, 102 bp, Arabidopsis thaliana
gaggttggggttgttggttttgaagttgttatatcctttgtagccaccctggttattgttgatgtagctgacttcttctaactagttaccctccccatcttg

SEQ ID NO: 1119 - DNA, 134 bp, Arabidopsis thaliana
aagtctactggtaaagtatatatcccattttttcagattatattagaacactgttgtatcttgacatgttttttgtatttgaacagtcaatgatatgcttgtgttcttgttgagatggttcaacaagttcccag

SEQ ID NO: 1120 - DNA, 113 bp, Arabidopsis thaliana
ctgtgagattcgtttttgagtgtagaaatccgccaggttgggatcaatcaatcccagaaatggatcgatcaatctagtcctgacgtaaggctctcaaaaacatccgcaagaag

SEQ ID NO: 1121 - DNA, 87 bp, Arabidopsis thaliana
acctgacgaaactgaacccggtttgtacgtacggaccgcgtcgttggaatccaaaagaaccgggttcgtacgtacgctgttcatcga

SEQ ID NO: 1122 - DNA, 68 bp, Arabidopsis thaliana
tcgagtgttcaccatggagtctgcgacaaatacttttgtatgttgaagaattttgtggaaatcctcat

SEQ ID NO: 1123 - DNA, 83 bp, Arabidopsis thaliana
aaacagaggcgtcaagagtaactggtgtcgatcgacaccctggtgtatcgatcgacactgagtctttttctgcaactggaaaa

SEQ ID NO: 1124 - DNA, 78 bp, Arabidopsis thaliana
gaggggtttttcactgcttttagtgctttcaagaaaaagcaagaggatgaggaggacgaggtagtgaacaagcttgtg

SEQ ID NO: 1125 - DNA, 128 bp, Arabidopsis thaliana
cttgaaagcgtgtagggtttttgctgggccgaaactggtgtcgatcgttagcaagagtgtgtcggtcgacactcctcgctgattcctgagccaaaatcgtccttaccttccttttccttagcttttgc

SEQ ID NO: 1126 - DNA, 83 bp, Arabidopsis thaliana
ggtttttgctgggccgaaactggtgtcgatcgacaccaagagtgtgtcgatcgacactcctcgctaattccagaaccaaaatc

SEQ ID NO: 1127 - DNA, 107 bp, Arabidopsis thaliana
ttgtgttacctactctgtcttatatcatgcgattgttgtttgttctgtttcaggttaagaacttaattgagacatgcatttacaagtacatgagtttggaagaaacg

SEQ ID NO: 1128 - DNA, 141 bp, Arabidopsis thaliana
gataaagtgtgattgtggaatcatggcaaggaagagaggatgatctaggaactcgtttgttttatgtttggtgtttttgtttattggaacccggttaggattgtcagttattcttggttttgttgatcgaattatttattt

SEQ ID NO: 1129 - DNA, 107 bp, Arabidopsis thaliana
gattgtttattacattttctgttttctcaccagtcctttgattcgtaaatattagatttttgatgaagtgatttatgagagagattgttaaagtatagagaatatca

SEQ ID NO: 1130 - DNA, 136 bp, Arabidopsis thaliana
tgtccttggatgatttgttgaatgagttgcttaattttaggatcttgagttgctggggcttgttgtggttgttgagtgaaccctggtggtggattctgctgttggtagcctccattaaattgttgtttagggacat

SEQ ID NO: 1131 - DNA, 133 bp, Arabidopsis thaliana
gtgaagagatcccttctttccccttctctattcactgtgttcatgctttctatctcaattatgttgtttgtttcattcaatatgtctgagtagtctgcttgttaggaatagggtttctcattagggattcata

SEQ ID NO: 1132 - DNA, 94 bp, Arabidopsis thaliana
acctgattggcacaaagcacattttcaagtactaggaagaggtaaactttgaaatcagtgttggaaagcttttaccctcatgtgtcaattagct

SEQ ID NO: 1133 - DNA, 60 bp, Arabidopsis thaliana
tttgtcctgagtactctcttccaaagttgtgtgatttaagtttgggggagggctcaggaa

SEQ ID NO: 1134 - DNA, 88 bp, Arabidopsis thaliana
ttttggggataaaagtttaagagaagtgtatagagaaaaggagttttccttctgtgtgaattttgatgtttataacttgataaccctt

SEQ ID NO: 1135 - DNA, 82 bp, Arabidopsis thaliana
atctaaagcaagaagattatggatgatgtcttttatcaagttgtcaagcttcacatccttatcttcttctgcatcactccat

SEQ ID NO: 1136 - DNA, 94 bp, Arabidopsis thaliana
agagtgattggtcgagtgaatgatgatggtgatacttgacctgttggtagagtgattggtcgagtgaatgatgatggtggtactcgaccatgta

SEQ ID NO: 1137 - DNA, 69 bp, Arabidopsis thaliana
gattttggatccgtgaatcaagaggagtgtcgatcgacacactcttggtttcgatcgacaccagtttca

SEQ ID NO: 1138 - DNA, 75 bp, Arabidopsis thaliana
ggtccaacaactctgagcaacaatattgatgtgtaccttgcaccattgattgatgatttgaaagatttgtgggct

SEQ ID NO: 1139 - DNA, 79 bp, Arabidopsis thaliana
ttgggaacaaaacattaattgtagtaaacaaaaggtttgttctgaccttgttgttgctgtggtggatacacttggttct

SEQ ID NO: 1140 - DNA, 94 bp, Arabidopsis thaliana
tgacaggaaccgcgttttcacaaaactgtggtacaaacgggtgtaaaggcaacatgtgctgcagcaggtggggatattgtggtaccacaaaagc

SEQ ID NO: 1141 - DNA, 131 bp, Arabidopsis thaliana
atgagtttcttcgccctctttctctatctcggtttagcatcatcatatatcgatccgtataaaattttgattggttgtagcgcgggagcagctactccatgctgtggctctgtgggggtgggggcagccta

SEQ ID NO: 1142 - DNA, 117 bp, Arabidopsis thaliana
aaaagaagatcacaatggattgggaacaaccagagttgacaacgaggtttagtcatgaaatctctctctctatgttctggtcttatcaacaacatcttctttttatctataattttc

SEQ ID NO: 1143 - DNA, 113 bp, Arabidopsis thaliana
ttctatctagacagttggtgacaaataagaagtatgagatgcggtggttgtttgttgggacaccaattcacttttgcattgatgattttgagctggtaactggtcttaacttc

SEQ ID NO: 1144 - DNA, 98 bp, Arabidopsis thaliana
taaacaaatgggctctatgaagtatcaggtgtcgatcgacactagtgtgggtgtcgatcgatagtcactcctgcaagataagtagagacaacaatctc

SEQ ID NO: 1145 - DNA, 89 bp, Arabidopsis thaliana
agcctggcctcatttgaatcagcgggtgaaggagtgttaaccgcatcgcctccgttctctctatcttctgattcatttaccaccacatt

SEQ ID NO: 1146 - DNA, 85 bp, Arabidopsis thaliana
aataggactaacaggagaatcaagaaccgatgatttcttctctggcgaagaagaagaatggtgatgatgatcttgatcaataaac

SEQ ID NO: 1147 - DNA, 140 bp, Arabidopsis thaliana
ccaagaggcgatgcatagtccatagtgttgatgcatcacgtctgcatcttgagtttgagttttgtagatgttgcagatgtgcacttgtcagggaaaatgaaaataagaagaaatcagctacaattggtttatcaattata

SEQ ID NO: 1148 - DNA, 122 bp, Arabidopsis thaliana
cggtaggagaggttggggttgttggttttgaagttgttataccctttgtagccactctggttgttgttgatgtagctgacttcttccaactggttaccctcccatcttggacctgatatttt

SEQ ID NO: 1149 - DNA, 121 bp, Arabidopsis thaliana
aaacttgaaaacgtcatggactttgctgggccgaaactggtgtcgatcgacaccaggagtgtgtcgatcgacactcctcttgattcttgagtccaaaatcgtccttagctttcttttcctt

SEQ ID NO: 1150 - DNA, 95 bp, Arabidopsis thaliana
tatttgcccgtgtattgtttgtcgcaacgttgatcgtcacttagctgttgatgttgttgatcatcttgtaacaaggggaatggattggagttata

SEQ ID NO: 1151 - DNA, 87 bp, Arabidopsis thaliana
ctgacgaaactgaacccggtttgtacgtacggaccgcgtcgttggaatccaaaagaaccgggttcgtacgtacactgttcatcgacg

SEQ ID NO: 1152 - DNA, 78 bp, Arabidopsis thaliana
aaagatggagaaatcagaacaagcaatgaatgtgattatcgctcacgttggtgatgttgttctgaggaaaattgatca

SEQ ID NO: 1153 - DNA, 134 bp, Arabidopsis thaliana
tggaacaaaaggtttaacaagtttatgacagatgagaaatttcagagaagtgatcatgatcagtgtgtatatgtgaagacaatgaacaatggagaacttgtctatcttctgttatacgttgatgacatgttgat

SEQ ID NO: 1154 - DNA, 125 bp, Arabidopsis thaliana
aatttgtattttctttggttgtagtgagaggattataacttgtgttgctagaggatctgtgtgtgagtcttttctgtcaaagttttatcaacttattggttcaaaaggttacaactatgagccac

SEQ ID NO: 1155 - DNA, 79 bp, Arabidopsis thaliana
aatcgtgggcgttgcattgatcatcatcatcatgatgctgttgggttatgcatggtttgtctgtcgcccccgagaaaag

SEQ ID NO: 1156 - DNA, 123 bp, Arabidopsis thaliana
tctctcgagtcttctgtttaaattctttttgaaatccatgtaactgacttaatgaggggatatgcagttggagttttgtaaggaagtgagtaagaaactgagagcttgtggagtgagggctga

SEQ ID NO: 1157 - DNA, 84 bp, Arabidopsis thaliana
aactcgcaaaatccctcgtcgatcatctcgtgtagcttcgtcagctcgaagacaagtgaatcgtgatgatgatgatgagagttc

SEQ ID NO: 1158 - DNA, 90 bp, Arabidopsis thaliana
caaagtgaacaaagcgccactgtctctctctcgtctggtccgatacatggacggaaaggtttgaattttgttgttgtttaggttgttact

SEQ ID NO: 1159 - DNA, 108 bp, Arabidopsis thaliana
ctgtgtttcttgatttagagtcagattttgtgtttggtacgaatcaaaggcttgagcttttggtttgatggttgtagaaattgaataaagatctgttcttgaatcctt

SEQ ID NO: 1160 - DNA, 83 bp, Arabidopsis thaliana
cgagaagtttaaggtatgttgatgtagagcacaagtttttcaagtttgtgtagatctagatctagatatatttggtattttag

SEQ ID NO: 1161 - DNA, 115 bp, Arabidopsis thaliana
atactttcaagattgatcgatctctcaagtctcaacaatgtcatcatcatcatcagttcctgcttacttgggagatgaagatctgacacaagaaacaagagctctgatctcttct

SEQ ID NO: 1162 - DNA, 103 bp, Arabidopsis thaliana
aaaaccacaaccaaagtccaaagcaacagtgagagagagagagctcacaacaaaaagatttcaactttactcgtttgaaactgagttctctcagaaagttctc

SEQ ID NO: 1163 - DNA, 115 bp, Arabidopsis thaliana
tctctcatgtacatggttcattgtaggaagacatccacttcagattgttatggaatgtttttccaagagaaaaattctttgaagaagttgtttgataaggataaacagagagtgt

SEQ ID NO: 1164 - DNA, 105 bp, Arabidopsis thaliana
gggagagactaaggaggtgtattttttagagagagagagtgagaggcttcttactgttagaagtcgttcctcttctctaatgagtcaatatttttttattttttt

SEQ ID NO: 1165 - DNA, 343 bp, Arabidopsis thaliana
tatgagcaaaggcagggatctctttgggggagtattgacttgctcttgactcgggtctcgtaaagcaggtgattcaccaatttaggtttacatccacagtgtggaagacactgaaggacctaaactaacaaaggtaaacggctcagtgtgcggggtattacactcggtttaatgtctgaatgcgataatccgcacgatgatctctttatctttgtttgtttaggtcccttagtttcttctataccgtgaatccaatcctgtattggatgagctggtttatgacctctgaatcgagagcatgtctatgctccctaaagagatcagagtattagatcctttgtga

SEQ ID NO: 1166 - DNA, 92 bp, Arabidopsis thaliana
gagagcttctcgagattgttgatgttgttgttgttgttaaggttgttgtcggaatgattagaggaggatgaatggtgttgttgttgtcttaa

SEQ ID NO: 1167 - DNA, 130 bp, Arabidopsis thaliana
caaaacagtagagagagaaagagatatagagatagagagagatagggctttgaggtttgtgtttgtattataatacataatatataggaatagtgtcttcttcttcatcatcatcttctatctcatcatc

SEQ ID NO: 1168 - DNA, 93 bp, Arabidopsis thaliana
attagacgactagcctaccaaaaatacatttataatgtggattttgatatgtgtgtgagtgtgtttacttcgtggagtttgatgtgtttaagg

SEQ ID NO: 1169 - DNA, 127 bp, Arabidopsis thaliana
atcttcataatttgctcgctcgccataatctcttttatacgatcaaagttgttgtaatgttgatatgatgatgatggtgcaatggagaggtttaagtttgtggtatcatgattatgattatgatgat

SEQ ID NO: 1170 - DNA, 129 bp, Arabidopsis thaliana
tcatggaaatcctggagtacacattcaggagattggtgatgatggtcaaccaattcaagatggtgatgaagtgggtgaagaaattgttccaggtcccgttggtgctgatgtcaatgaagcaaaagagga

SEQ ID NO: 1171 - DNA, 85 bp, Arabidopsis thaliana
cgttctatcatcatctttgggatctgattgggaatgatgtttgtttgatggtgcgacatttttttgaatcagatgtcatggataa

SEQ ID NO: 1172 - DNA, 76 bp, Arabidopsis thaliana
gtcggaatagctgggattcattcaagcatttggtctctgaggagcagtcattatcggagtttgatatttctagcaa

SEQ ID NO: 1173 - DNA, 102 bp, Arabidopsis thaliana
attggtcggagtcttacacgtgaagaccggagagctctcgagtttcactttgcagctgctgatgttattcaccttgtgtgagagtccgtacgtgatgaagta

SEQ ID NO: 1174 - DNA, 78 bp, Arabidopsis thaliana
aaccacgggacttcttcttcatcatcatcaatctctaaagataagatgatgatggtgaaaaaagaagaagacggtgga

SEQ ID NO: 1175 - DNA, 79 bp, Arabidopsis thaliana
gtctcatggttcagtcgaatgataagaatctggagcctagaaaagagcattatgcatgtatggttgatctattgggacg

SEQ ID NO: 1176 - DNA, 121 bp, Arabidopsis thaliana
tttctattgattaaaaaactacaaacaatactcttcttgttggacgaagcaatatttacacacacacatatatataaggatgtgaaaaaacgttgtggatttgtctacgagggtttaacac

SEQ ID NO: 1177 - DNA, 96 bp, Arabidopsis thaliana
catccggaatatatctgctggaattgaaataaacatgtcgattatttcctctggaatatcaacatcttcaagaacctgcagaggagcaaggataag

SEQ ID NO: 1178 - DNA, 105 bp, Arabidopsis thaliana
cacggtgagtcactcttttctcatttcaagatgcattattcagttacatcatcgtaaatgtgtgtgtgtgtatgtgcaggaaagccggggatgatgaccatcgct

SEQ ID NO: 1179 - DNA, 78 bp, Arabidopsis thaliana
agttgactgtgatgattgtttgtgtttttggtggcaggaccaggaggcgcagagagggaggatgcaggagatagatct

SEQ ID NO: 1180 - DNA, 82 bp, Arabidopsis thaliana
ctttaacactctcctccaaatcccagatctctctctgtctctgtcccgcggagtccccgagagattgatcaccatcactttt

SEQ ID NO: 1181 - DNA, 98 bp, Arabidopsis thaliana
tgtattcatatttcaaaggtacatttgcaacaccattgattctttattccaattcttatctacgtgtgtgtgtgaatgaaacttgaaaccaatacaag

SEQ ID NO: 1182 - DNA, 126 bp, Arabidopsis thaliana
gatcggagagaaagagaggatgggaacgagacaagtatacgaagagaagcttcggcgtgggaatcttgattatgatccgactatgaatcctggtcttggttctgctcggtgtcctcgttgtctttc

SEQ ID NO: 1183 - DNA, 89 bp, Arabidopsis thaliana
ggagggcgtggacgtggaggccgtggtggtcgtcgtggagggcgtgccagtgaagaagagaaatgggttccagtgaccaagcttggtcg

SEQ ID NO: 1184 - DNA, 116 bp, Arabidopsis thaliana
attttccttttttctctttccactggttgcttggactagacgaagtttgatcaatccactgactttcttcttcttcgataatattggcaactgcaagtggagtgacagaaagtaat

SEQ ID NO: 1185 - DNA, 83 bp, Arabidopsis thaliana
gagtgttggttacttgttcgcgatccagcacggtgcgaagaagatctatgatgctgatgatcgtggtgaagtgattgatggag

SEQ ID NO: 1186 - DNA, 109 bp, Arabidopsis thaliana
ggacttcaaaggtaaaactggaccagcaattgagttctcatttctctgttttgtctgaaaaactatggaatcaagagtgatcatctttgtgtaattgcctataaggaag

SEQ ID NO: 1187 - DNA, 107 bp, Arabidopsis thaliana
gagaggaagaattctggagtagggggataagtgcttgtgctatctgtgatggagcttcgcctttatttaaggggcaagtacttgccgtggttggaggaggagatacg

SEQ ID NO: 1188 - DNA, 88 bp, Arabidopsis thaliana
gtatttgttttaaaagtgtttcctttgatcacatttgaagttgtagttaatgtgaatgtgttctagtgaaacaagaatagatggtgta

SEQ ID NO: 1189 - DNA, 90 bp, Arabidopsis thaliana
agatgggtccaggtcgagatcaaggggatgaccataacagtcagagggaaggtatgagtcggcatcatcatcatcatcaagacccatcta

SEQ ID NO: 1190 - DNA, 99 bp, Arabidopsis thaliana
accgaatctaccatggcttgttgatgcaggaggatgtgttgtgcttgattttcttgtatacgatctctctcttcaagttccatgatctttgattccttt

SEQ ID NO: 1191 - DNA, 111 bp, Arabidopsis thaliana
ctccagaaagcgtttcatgtttcttctgttgctgtgaaagtgtatatatttgtcgaaatagcgatgatacttgtggcaacagcaagaacaagcattactgaagctacaatc

SEQ ID NO: 1192 - DNA, 96 bp, Arabidopsis thaliana
gtaagagagttgggtagtgatgataatcatgtgagtgcatgtgcatcgagttgtattttgatgacatgtcctctgatttaagctaaaccctaatta

SEQ ID NO: 1193 - DNA, 82 bp, Arabidopsis thaliana
tcaggtttctgatttgagcttggaggttgattagttattgatggggtttggtctatttaggttcaaagcatggaacttcgcc

SEQ ID NO: 1194 - DNA, 97 bp, Arabidopsis thaliana
tatagatgtcggtttacttgagcgtactatgtttcacttcacttgaatttacggaaataagtctgtgtgtatgtgaacgcatctataagtatgtcat

SEQ ID NO: 1195 - DNA, 72 bp, Arabidopsis thaliana
taactcgttcctctctctgtgtgtggttttggtagacgacgacgacgataatggaggagctagatcgttcac

SEQ ID NO: 1196 - DNA, 71 bp, Arabidopsis thaliana
gagagtagagaagagtgaaagagggggattttaatgcatcaaagcaaatctcagtctctttctctgcacct

SEQ ID NO: 1197 - DNA, 131 bp, Arabidopsis thaliana
tcacatttgttgaaaccatgatgcatttgttcttgttgattgatacttttctgaatttctttgtgttttgtgtacataggaagagcaggataatttggctaaaagcgagacattggcgattagaatatcaa

SEQ ID NO: 1198 - DNA, 125 bp, Arabidopsis thaliana
aatattgtatcattcttattcttcgtcttgttggctgcttcaggttcacgttcatcttcatcatcgagttctgcagtctggatgaagctacagaggaagaaggagaatgaggcgaagaaaaagga

SEQ ID NO: 1199 - DNA, 125 bp, Arabidopsis thaliana
ttttttcaattcattctagattatttacacttatcctttgttggttttgaatctttgcagtttgtgcttgaagatggtgaatatctcatgaacatagatggctactacgataagatcttcggagt

SEQ ID NO: 1200 - DNA, 85 bp, Arabidopsis thaliana
cgacctgcggttcggatttctgctgatggagcagctgatactgtggatcaggctgtttccatggcgtttggtcagtgtaggagga

SEQ ID NO: 1201 - DNA, 111 bp, Arabidopsis thaliana
atcaaagatgtaatacatgttttttttaggtaatacatgttgtgtgtgtatttggtactggtggccaaatttaaatataaccaaacatgcttatttagaagaagaaaaaaa

SEQ ID NO: 1202 - DNA, 121 bp, Arabidopsis thaliana
ttcttttcataatccttatatagatagtctcatgtttcgtaagattgtttctggagatgggttttcttgtggtgttactaaagatggagacttggtttgttggggaccaaaatcaaacctt

SEQ ID NO: 1203 - DNA, 61 bp, Arabidopsis thaliana
tcatggagttgagtgttggggaaggaacttgaattcttcttcatcatcttcagctcctaat

SEQ ID NO: 1204 - DNA, 106 bp, Arabidopsis thaliana
tgtaacagatttgtgtaactcgttgcattccatatctttctcttcaaagtttcttgaagtaggagagtaagatgttattttgcagagtaaatataatttgcacaaa

SEQ ID NO: 1205 - DNA, 95 bp, Arabidopsis thaliana
cactcttcaaatcaagaaacctcatggtctgattttgttttgctattgagacattgtcgtgattttggttgttgatgtagcggggtcgattaaca

SEQ ID NO: 1206 - DNA, 90 bp, Arabidopsis thaliana
caaggattcttcatcgtgttgaagttgttgaactttcttttctagactcgcctgattgaaatcatgcaatttttacaaggagaatgcatt

SEQ ID NO: 1207 - DNA, 85 bp, Arabidopsis thaliana
ttgttcagtatctttgtgatcttcctcaccgatgttggatctgttctggtttcggctatgatgattggtgttgcgttgatctgtg

SEQ ID NO: 1208 - DNA, 80 bp, Arabidopsis thaliana
aatgaaactcaggatggatagcgccaaaaaatagataacgaatgtgatcatcatggcgctatccctcctgagctttacag

SEQ ID NO: 1209 - DNA, 90 bp, Arabidopsis thaliana
acaaaataatgtgtgtgtgtctgcctctctgtctaacccatacgtaggtcatatagacacgcactaaagatacaattgttttggtggatg

SEQ ID NO: 1210 - DNA, 88 bp, Arabidopsis thaliana
ggtttctattatgatccaaacagcaggttagtccaagatacaaactatataatctgttgttgtttgagataaaacctgatgatatttt

SEQ ID NO: 1211 - DNA, 85 bp, Arabidopsis thaliana
atgaactgggaaggattaggagattttgaagatgaagatgatgatagattcttcgaaactcatgatcgtctctcttctgctttaa

SEQ ID NO: 1212 - DNA, 99 bp, Arabidopsis thaliana
atttctcactctctcgtcttcttcgtctgagctatcaaactccagtcaatggcgatgatgacgacgacgacgacaacattcttccatccactacttcct

SEQ ID NO: 1213 - DNA, 138 bp, Arabidopsis thaliana
atgagccgccatgcttggtttgtacgtgtgtgtttatatagaagataaaactaggacttgtttttattttattttaaatttgatatggtcttaattcgtatttttgttcaaagttcacacaaataaaaagcgacggtg

SEQ ID NO: 1214 - DNA, 146 bp, Arabidopsis thaliana
cttcgtacacaagacatgcaactatgagtatcgggagatctttgatactgagctgttgtgtgattttttttttttttttttatttaggaatccgcttctggtacttgattgttgctatgctgtgtctcgtggaggacgaagggtaa

SEQ ID NO: 1215 - DNA, 100 bp, Arabidopsis thaliana
aatttatgacatatcactgacttaatgttcttgtttttattgtaggatcttatctctcttctctgagagctataaaacagaagacagtgatgatatacac

SEQ ID NO: 1216 - DNA, 110 bp, Arabidopsis thaliana
tcattgccatattgaaaagtgtaagcactttgtggttaggctcagagttatgtccatttcttttgtttgcttcatgttcagggtgtcagatttatttgaattggctttca

SEQ ID NO: 1217 - DNA, 84 bp, Arabidopsis thaliana
tcgccaagaacttcaatataccaaagatagttttccacggcatgggttgctttaatcttttgtgtatgcatgttctacgcagaa

SEQ ID NO: 1218 - DNA, 85 bp, Arabidopsis thaliana
tcaaagttaagattagagttgtgatggttatgtgtgcttgtgcagcataagtgacatgtttccttcagttagtctcaactttgct

SEQ ID NO: 1219 - DNA, 96 bp, Arabidopsis thaliana
ggagataatggtaaatcatatttctgaacataaccctacgcacaaaaagtaggaatggtggtggttgtgtgaatgattgctgttttccactccata

SEQ ID NO: 1220 - DNA, 99 bp, Arabidopsis thaliana
ctgttgatcggtgatatcgtcagaggaggaggaatggaggatgaatctttttgccagaatcttttcttcttcttcttttgtgtgagtgagagagagagt

SEQ ID NO: 1221 - DNA, 100 bp, Arabidopsis thaliana
gtttctggtgttgtgtttctattgattgtgattacgagcttaaaaatggggatgattcattttgtgtttgattattagagagtgggcgcaagactaggtc

SEQ ID NO: 1222 - DNA, 89 bp, Arabidopsis thaliana
ttgatatgtgcatcatctgcaatgtccaagaacttatgaaacaaatagtttattgatctgtggttgtgtgatgatcttctagatatcat

SEQ ID NO: 1223 - DNA, 126 bp, Arabidopsis thaliana
gattacggaggtaagtagtatcatcaactttgttctgcattttcttaatgtcctttgtcataatcataatcatcaagaacttgtctgatcaaagtctggtttgcatcactcttaagtaaacactga

SEQ ID NO: 1224 - DNA, 113 bp, Arabidopsis thaliana
tgaatacattggggtttcggaaatttcatattcatgtcattgattttcttgcaggcaagtaaatcatatatgtcctggaaattgtattgtgaaatgagaagtcaccaatgtaa

SEQ ID NO: 1225 - DNA, 100 bp, Arabidopsis thaliana
gaacttcacttacagagcttagagccatggatacaggtaataagaaactatctatgtaatatgttgttgggtttacgttctgttgttgtgaaacttgttg

SEQ ID NO: 1226 - DNA, 93 bp, Arabidopsis thaliana
ccgacgatagtaaaagatggatgtgcattggagggtttgtgtatatgttcagatgatgctcattgtgctccgtccaaaggctatttgtgtcga

SEQ ID NO: 1227 - DNA, 123 bp, Arabidopsis thaliana
taataagattccataaaagcattgctttgattttcagacagcttctggctgaagttttggttgttggcttattgcgctttagctactgtctctctggagtttagacagttgatgtgagtttat

SEQ ID NO: 1228 - DNA, 106 bp, Arabidopsis thaliana
tgctagattttcatacaataggttcaatcctttctgtggttgttgattaatggatgtctgtaattgcttaagagattggatcttagaggccacaggattcgcagtc

SEQ ID NO: 1229 - DNA, 84 bp, Arabidopsis thaliana
actcttgtggggattgctgtggtttggggtatagtgataatggttcttgtttactgtctcggccacctctctgcacatttcaat

SEQ ID NO: 1230 - DNA, 219 bp, Arabidopsis thaliana
tgaagaatatattaaatagtagtgaagatgcatgtttatgaagacagagagataatgtatggttggattactgggcgaatactcctatggcagatcgcattggctagatatgcaagtaaaatgcttctctgccaaaggagatttgccccgcaattcatcccatgcaaaacaatatatctttctttatagtctctaggcaatttatggttatatttcttg

SEQ ID NO: 1231 - DNA, 125 bp, Arabidopsis thaliana
cagaaggtaaaaatgtactatacctcagcattgcacaatgagcagaacaaagcttcttcttgttcgtttgattgctcttgttgggtatctctacggcaatcttgtattactaaacaaccacaaat

SEQ ID NO: 1232 - DNA, 110 bp, Arabidopsis thaliana
aaataacaaaaactcagaaatccatggtgaatgcacaactcttattattgagtaaacgatgagagagtgtgtgtgtgtgtgcagaatggaacactataactataacatat

SEQ ID NO: 1233 - DNA, 79 bp, Arabidopsis thaliana
agtctctctctatttctctgctctcgcaggagagggatatatttgaaagctctgtggagtggtggaggagagagatgac

SEQ ID NO: 1234 - DNA, 65 bp, Arabidopsis thaliana
attaattgtgaatgcatctgctggaggaggaggtcctccactttccagtacatgttgttcaagct

SEQ ID NO: 1235 - DNA, 60 bp, Arabidopsis thaliana
atgggccaacagtgtttcctgtccctgtgctgttagcaggaccagaagaggaaggccctt

SEQ ID NO: 1236 - DNA, 68 bp, Arabidopsis thaliana
attgttcttctttgtgtggattgtcatgaagttgcacatgctgctgcagagaggtacaagaaacaaat

SEQ ID NO: 1237 - DNA, 150 bp, Arabidopsis thaliana
gccaaataacgaaaaatatattcaaaagtggtcaaaacacgtcactatttcctttatgttttccccttattgatggaaatggttaaacatgaaggtagtgaatttgttcgaataatatgttgatatattttgatcaggggcggttcttca

SEQ ID NO: 1238 - DNA, 81 bp, Arabidopsis thaliana
ccatctcaatgttttcgtatgcattttgcattaatgatgatgattgattgatgaatgatgcaggagtctgaagatggaacc

SEQ ID NO: 1239 - DNA, 89 bp, Arabidopsis thaliana
accttctgatggacaggaacacttggttgatgatgttggagctggttttatacctggacatggtagtcagcagccatcttcttcagaac

SEQ ID NO: 1240 - DNA, 81 bp, Arabidopsis thaliana
aagcttttctacttaggtcctgaatcttcttcttcttctatgaaagagaaagagaaagagaaagagaaagagagagagtga

SEQ ID NO: 1241 - DNA, 97 bp, Arabidopsis thaliana
ctaagatggtgatgatgatgtagttgttgttgttgctgcctcatcttgcgaagaagaagaggacccgttagatgaaggagacatatcgtcgccagca

SEQ ID NO: 1242 - DNA, 88 bp, Arabidopsis thaliana
cctgtttgttatttgagaataaagaaacttgagtgtgatgatatatgcttctgtttcattatcttcttatctctcggtgaggaactct

SEQ ID NO: 1243 - DNA, 138 bp, Arabidopsis thaliana
attgctctatgtgctttgttgttctggttgatacacataactgacgcagatgcttgaagttgtctgttttgatgtgtatttgtaaaatagtcaggatatgagtattagcataactatatcaccctttgaaaatgtatt

SEQ ID NO: 1244 - DNA, 86 bp, Arabidopsis thaliana
ggtgactttgtggtggtgatggtggtggtgctgacgttgtgatggtggtggtgacttagctttgtgatggtgatgacatagggatg

SEQ ID NO: 1245 - DNA, 132 bp, Arabidopsis thaliana
tttgtgtatttgaattataggttgaacgagtcgttggtatggttgaaggagctatattagttgttgatgctggagaaggccctcttgcacagactaagtttgttcttgccaaagccttgaagtatggactac

SEQ ID NO: 1246 - DNA, 115 bp, Arabidopsis thaliana
gagatcttttacaggcaagttgttattgtgacatgatacaaactgttcgtttgatacaaatttatatttgtttgtgtgatttgttttgtagcttatgaccaatgatcagtttgtg

SEQ ID NO: 1247 - DNA, 137 bp, Arabidopsis thaliana
ttcttcagcaaatgaaccagactcactttttgatgtcaagggctcggtatgtccattgacctcatcttcttcttcattactgaagtattcttctgcaacattgttttcattaacctcactttcttcctcacctgact

SEQ ID NO: 1248 - DNA, 76 bp, Arabidopsis thaliana
gaacgttttcttcctctatagacatcttcttctctctcagaaactgatctctctgtattgatcggaagaaaatgta

SEQ ID NO: 1249 - DNA, 131 bp, Arabidopsis thaliana
tctccatattattttgaatatatctatcaattgtcttatttgttgtgattagtaacctgtatattaatatatggtttggtccatctctgattttgataggtactgaatttgatgtcgagacgtcgacaatt

SEQ ID NO: 1250 - DNA, 89 bp, Arabidopsis thaliana
gaaacaagaaaaagtgtttccatggagtgtgtgtgtgtgaagagatcttcgatgggtctctctttatatatattcaaggaacaaaatgg

SEQ ID NO: 1251 - DNA, 117 bp, Arabidopsis thaliana
gtaggtacgattttgattttgacttatcggattcgatttttagtatttgggggaaatttagcatttacttaattagaggaggaaaaaggtaataggcaaaattaggagtgtatttag

SEQ ID NO: 1252 - DNA, 81 bp, Arabidopsis thaliana
gtttgatattgactatgtggtgttaatctcattatttaaatggtgttgatgatgcagcacaagacaagattgcagattttg

SEQ ID NO: 1253 - DNA, 102 bp, Arabidopsis thaliana
gcttgccatcaaatattgtggtgacagtttgcataagtgtttctctttcgagacgattggatgcatcgcagactgaaccactcacttgaaaccctttcttct

SEQ ID NO: 1254 - DNA, 67 bp, Arabidopsis thaliana
actagtcaacacgggaaaggtaacacgtgacacagatgtgtttgcgtttggagtgttgatgatggag

SEQ ID NO: 1255 - DNA, 82 bp, Arabidopsis thaliana
aaagggttcgtcgtaatgatgctgatgagagcaatgcggagaatagtgatgagaatcatcaagcattagacaaagaaccgaa

SEQ ID NO: 1256 - DNA, 136 bp, Arabidopsis thaliana
tttcaattagtctcgaaaatgtttcaactttgagccagtttggttcaagaaactttactttgtggtttgtgattgatttctcgaagtgggtctgttgttatgtgtgtgtatgactctgttaaagtttcaagtttag

SEQ ID NO: 1257 - DNA, 91 bp, Arabidopsis thaliana
tgtatcagagtttatgtgtaattcaaataataggagctagtaatcgcagctatgctcatattggtgatgttgttgttgccgtaattttgat

SEQ ID NO: 1258 - DNA, 143 bp, Arabidopsis thaliana
caatttttatttttcatcaagtttcttagatcatcaggttgattgatactctaatcagtgtgattgtgtatgtaaatgcatgtgtattattctgtttttggttttctaaatctcatgatgaatctgtgattagagtttattaa

SEQ ID NO: 1259 - DNA, 84 bp, Arabidopsis thaliana
caaattcttgtgttgtgtttcagcttttgttcttgtgacagaacccacggaggctttgactgcagcattgaaattgtgtcacac

SEQ ID NO: 1260 - DNA, 124 bp, Arabidopsis thaliana
cttttcaaaacaatttatatttttgagtaagtcatcttctgtccttatattttaccttgtttatggttttctacattgcagaaaatggagcaggagaagcttcagaagttagctcgacaggtaa

SEQ ID NO: 1261 - DNA, 99 bp, Arabidopsis thaliana
gaattgacttgaaattgaaaggttttgtgtggagattagtaatagaactgtgcttagttttgatcttgatgaccttcaatgtgtggagctatgttttgg

SEQ ID NO: 1262 - DNA, 99 bp, Arabidopsis thaliana
attgctgttatattcgttgaagttcccgccttgactctgtttcttcttctcgcaatcacattcctctctgaagcagcgatcaagaaaaagcaagagtct

SEQ ID NO: 1263 - DNA, 108 bp, Arabidopsis thaliana
atttaatgatcgttttatttcatttcgatccctttcttttgattgatttttaggctaaaaatgtcaaattgatttgggttttgtgtgttatgtggtcaagtttatagc

SEQ ID NO: 1264 - DNA, 80 bp, Arabidopsis thaliana
aacgtccatctctgtgcttggcaagtccatatgcacttgctaggggctatcacgcagaggtacacaaagacatattaacc

SEQ ID NO: 1265 - DNA, 100 bp, Arabidopsis thaliana
caagtcacgtgactatctccctgccttgccttgtgcgccgcagagtgcatcgtaatctcgtgatggtggtggtggcacgtgcttcccttcacacgtttaa

SEQ ID NO: 1266 - DNA, 119 bp, Arabidopsis thaliana
ttgaaatttttgcttggttttgtataggattgtgtcttttgcttataaatgttgaaatctgaactttttttttgtttggtttctttgagcaggagatggattcaacaaatggtaacgga

SEQ ID NO: 1267 - DNA, 93 bp, Arabidopsis thaliana
tccttcaaatggtgaagtccaatctggagaggtagctgcttgttgtgtttccacgataacaccagcacctgaattctccatagatacaccgtt

SEQ ID NO: 1268 - DNA, 123 bp, Arabidopsis thaliana
aacagaatcagagagagatgataattggagaagatgagggaagagattgcagtgtagatttggttttggtttgttctccctctatctcttgttctgtgtcgtcgtcgtcgtcacattaatctc

SEQ ID NO: 1269 - DNA, 84 bp, Arabidopsis thaliana
caatttaattgctgctactgcatttatggaaccacctaaggaatggatgtacatagacaaaggtggtgcagaagtgggacctgt

SEQ ID NO: 1270 - DNA, 107 bp, Arabidopsis thaliana
tcacattgctcaggtaatctctttctttctctccgtaattcttcttctagctgcatccatgatgtgtttggtaagtgttattaagctgagccaaggatcctagcttc

SEQ ID NO: 1271 - DNA, 99 bp, Arabidopsis thaliana
atgaacaaagacaacaatgcagagattgatgatgtagatgttataagagatggagatcatctcatctttgcaactgattcttaacaaccatagaaactc

SEQ ID NO: 1272 - DNA, 66 bp, Arabidopsis thaliana
catttgaatgcagatgtgttcgtttgaattgttttttaacaatgtgcatctgcatctgaatgcata

SEQ ID NO: 1273 - DNA, 130 bp, Arabidopsis thaliana
cgtatgggtatggtcaagcgccacagggatatgggtcttatggaggatacacacaacctgctgctggtggaggttactcttcagacgggtctgctggagccactgctggtggtggtggtggtacaccagc

SEQ ID NO: 1274 - DNA, 65 bp, Arabidopsis thaliana
ttgcctgctctttcttgctcgcggataagactttgttggctgttgctgttgctgtggagcaggtt

SEQ ID NO: 1275 - DNA, 124 bp, Arabidopsis thaliana
gagaagttaagaaacaagaagaataatgtggtgatgagataaggagggtgatgatgatgatgagaagtagacatgtttgcttttgtttctttggctttgctctattattacatgaggttatttg

SEQ ID NO: 1276 - DNA, 128 bp, Arabidopsis thaliana
ggtgatagttgagttcagtggttggtctgagttgatgggtttgcttatatgtggatattgaaatatgtgtatgtgtggctttgagtaagttatcttgtactataagctgttatctgattacaacgttt

SEQ ID NO: 1277 - DNA, 129 bp, Arabidopsis thaliana
acatgaaacttcactaatgagcaataaaatacatgtcctaatagtttcgaacctgaggcagagaaagagaaagatagacgatgcagaggcttgagagaacgcaggactaaaatattcagtagatgaaaa

SEQ ID NO: 1278 - DNA, 113 bp, Arabidopsis thaliana
cttataagaacagtagtcttcaagtagatccagcatatgctgaaactgtgtgtttatgagaactctgtacacacagtttcagcacatgctcgacctattggaaaactactgta

SEQ ID NO: 1279 - DNA, 74 bp, Arabidopsis thaliana
agtatctgcttccaatgggcaaacaatcttgtttattgatgagatccacactgttgttggtgcaggtacctttt

SEQ ID NO: 1280 - DNA, 90 bp, Arabidopsis thaliana
aactgacagaagagagtgagcacacaaaggcaatttgcatatcattgcacttgcttctcttgcgtgctcactgctctttctgtcagattc

SEQ ID NO: 1281 - DNA, 96 bp, Arabidopsis thaliana
gaatggttggatccaaattctgatgttgctgtgactgttttcaaccaaataacagcagcaaatatccttcaagaaagcttggattcaggttctcct

SEQ ID NO: 1282 - DNA, 72 bp, Arabidopsis thaliana
gaagtgacagaggaatgagagtgagagatggattccaagaccccttactctcagttctaatttatggcacga

SEQ ID NO: 1283 - DNA, 92 bp, Arabidopsis thaliana
tctcgtcttggttacggtcaggttctgtggaaagatactctattgtaatagcttcttcttctacctctctgtgggatgaacgtaaacctgga

SEQ ID NO: 1284 - DNA, 124 bp, Arabidopsis thaliana
tttcttcttctgcttgatcattaatggtgtttatgtttgacgtagtttcttgttctgccattgttgttgatattcataagatgaaatggttttagatataaaatgttaaagtttgggaaaagaa

SEQ ID NO: 1285 - DNA, 113 bp, Arabidopsis thaliana
atttcttctgctttctcctctgttgttggtgtctaaatgtgcttgaactaattgtgtcttcttttgatgtgtgtttgtacagctatgtcaatggagacgaaaatcagatggtt

SEQ ID NO: 1286 - DNA, 137 bp, Arabidopsis thaliana
atcctgtaaacatatatatcaatatctctgcattcaaatcaaatatagagaacaaatgaattgttcttgttcttgcatctttgaatctttgcaaaaacaacaacacatttttttctctctatagaaatggatggaga

SEQ ID NO: 1287 - DNA, 85 bp, Arabidopsis thaliana
gaaccactacatacatatatgcatgaatgtgcattataacatgagaagatacatgcacacagtcacacatatatgatttttataa

SEQ ID NO: 1288 - DNA, 81 bp, Arabidopsis thaliana
tagtctgtcgttgtttttgtccatctctgggttaccaaccttcaaggagatattagggacatatatgaatatggagtaata

SEQ ID NO: 1289 - DNA, 91 bp, Arabidopsis thaliana
tcgttaacatcgtcttccttgtcttcctcatcattgtctactctgttggttgctgtgctttcaggaacaacaagagggatgacagttattc

SEQ ID NO: 1290 - DNA, 82 bp, Arabidopsis thaliana
cgagaagtttaaggtatgttgatgtagagcacaagtttttcaagtttgtgtagatctagatctagatatatttggtatttca

SEQ ID NO: 1291 - DNA, 72 bp, Arabidopsis thaliana
ttgcccatataggcatagctacgggaatattttctgtgtgtgtgtgtcagtgtgtgtcagtgtgtgtcaagg

SEQ ID NO: 1292 - DNA, 82 bp, Arabidopsis thaliana
ctttcggctccattgtcgtcgcttccaatttgtgtggaacaattggcttcgtatgagtgagtgtgtgtgtgattacgagaga

SEQ ID NO: 1293 - DNA, 303 bp, Arabidopsis thaliana
ttatgtgcaagcaataaagtggagtagtagagtgttgatgagtgagttcatgatggttaggaaggagatgtttgcagttggtttaatgaatcttttacattgaagagaaggaatggtaagattgcttataagctggatcttgagggtgagtggtctcttctacgcattgggcttataagccatcttactagttcttcttttcaatgttgtctaaggacgctgcttttatcaggtgatcatttgttttcccccttttcaacatctctgagttgcatactttccctgtgataaattgcaattgga

SEQ ID NO: 1294 - DNA, 82 bp, Arabidopsis thaliana
gaggtatgaataacactgacttagcgaatttagtcgcgtcggagatcgaccgattcgttgttgttgttggattgttcgtgga

SEQ ID NO: 1295 - DNA, 71 bp, Arabidopsis thaliana
agttgcaacaaaaatctaaagcagaagagctttcaaagcaaggctagagattgtgttgttggtaacgcttg

SEQ ID NO: 1296 - DNA, 88 bp, Arabidopsis thaliana
tatttctctaaaaacagaagtcttgtgattttggtccaactgacagatttcccatacaaatatgatttttgttttttagagaggatcg

SEQ ID NO: 1297 - DNA, 87 bp, Arabidopsis thaliana
ttgtttaggtagtgaaactagtgaaagagccaagaatttgttagaaacgaatgtgtttgtgtgtgttcatgcctgcctgaaaatcta

SEQ ID NO: 1298 - DNA, 82 bp, Arabidopsis thaliana
tgattttgagttagaaagctgattcctttagtatatttcaactgagattttagtggaatctgtgttcttgttcactctccat

SEQ ID NO: 1299 - DNA, 72 bp, Arabidopsis thaliana
atcctccatcttccatagagatatcatttgaccatgatggtggtggaaaagatctcaatgatgaagatgata

SEQ ID NO: 1300 - DNA, 84 bp, Arabidopsis thaliana
tgacgaaactgaacccggtttgtacgtacggaccgcgtcgctggaatccaagagaaccgggtttgtacgtacactgttcatcga

SEQ ID NO: 1301 - DNA, 180 bp, Arabidopsis thaliana
gtatgtatgaatgtatgaatgtatgtatgtgtgaatgcatcatgcattatgcatgaatgtatgaatgcatcatgcatgaatgaatgatgcatgaatgcatgaatgaatgatgcatgaatgcatgaatgaatgatgcatgaatgtatgaatgcatgaatgcatgaatgtatgaatgcatga

SEQ ID NO: 1302 - DNA, 141 bp, Arabidopsis thaliana
aatgcatgtattaatgcatgaatgcatgcatgaatgtatgaatgcatgaatgaatgatgcatgaatgtatgaatgcatgaatgcatcatgcattatgcatgaatgtatgaatgcatgaatgcatgtattaatgtatgcatg

SEQ ID NO: 1303 - DNA, 143 bp, Arabidopsis thaliana
gaaaacatagcatgtaatacattaagcaattatgaatgtgcaagggaacaagtatgcagtatgcatgtatgtatgaatttatgcatgtatgatgaatgtatgtatgtatgtatgaatgcatgtatgtatgtatgtatgtatgt

SEQ ID NO: 1304 - DNA, 123 bp, Arabidopsis thaliana
tcagttagatcgttttagtttcttctcttgtaacaatagtttgcatcaaccaattccttctttatgttctcatgtattttccattgtttgcaagaaagaagattaatattttcatgagtaata

SEQ ID NO: 1305 - DNA, 101 bp, Arabidopsis thaliana
cctaattcgtgtatgaacagaccagcacattgatctttgagtcttgaaaagctatattagtgttcttgatgttgatgtcgttcgctcatacgaaggaagag

SEQ ID NO: 1306 - DNA, 101 bp, Arabidopsis thaliana; identical to SEQ ID NO: 1305

SEQ ID NO: 1307 - DNA, 99 bp, Arabidopsis thaliana
taaaggtcaagactttatgtttctgatgttggttttattgatggatctttgtttaatgttgagacttgtgtttctgatgttggtttaatgatctttggt

SEQ ID NO: 1308 - DNA, 92 bp, Arabidopsis thaliana
gacgatatcaagatgcatctctctgccaccaaatacggtccttacctccaaaacggtgcgttatgatgatgattcctgattgtctctcacaa

SEQ ID NO: 1309 - DNA, 88 bp, Arabidopsis thaliana
gcccatgcattcaccaagatgattgtgccgcgtggaacgtcatagccatcaactatacaatcttctgatgctaagtggggtaaaagca

SEQ ID NO: 1310 - DNA, 112 bp, Arabidopsis thaliana
tcatattgaaaagttatgtacgtttatgtgtaataatgtacgtacatttttgttggtaaattaatgtatgtacatgtgtaataatatacgtacatctttgtttttgaattaa

SEQ ID NO: 1311 - DNA, 140 bp, Arabidopsis thaliana
ttatagacgtttatatatgaccaagatgttttagaataaattatacatgttatatatatatacactgtttgtgtgttcatatacataaaataaattatatctatacatatatatttatacaccgtttatgggccttaact

SEQ ID NO: 1312 - DNA, 153 bp, Arabidopsis thaliana
aaatatgcatagattcatgcaggaatgtaagcatgcatgaatgtatgcatgcatgtatttatgaatgtatggatgtatgtatttatgaatgcatggatgtatgaatgtatggatgtatgaatgtatgaatgcatgaatgtatgcacatatgaa

SEQ ID NO: 1313 - DNA, 145 bp, Arabidopsis thaliana
ggatgcatgaatgtaagaatgcaagcatgtatggatgcatgaatgtatggatgcaaacatgtatggatgcatgaagtatgaatgcatgcgtgtatgtatgtatgaatgcatgaatgcaagcatgtatggatgcatgaatgtatga

SEQ ID NO: 1314 - DNA, 102 bp, Arabidopsis thaliana
atttaggtaggaaaaaatgagacaacaccttgagaattcttttgctttgtataatctatatatatgtgcgacgatgttccagtgtttcatggtttatctcca

SEQ ID NO: 1315 - DNA, 139 bp, Arabidopsis thaliana; identical to SEQ ID NO: 1110

SEQ ID NO: 1316 - DNA, 101 bp, Arabidopsis thaliana
ttccgggtcatgtagtgtatgttgttgaggagaaaaatgtgttgtagagagacatctttgtatagttttgatttctcttgaaggttggcttcgaggacaga

SEQ ID NO: 1317 - DNA, 98 bp, Arabidopsis thaliana
ttttgtgttttggttattagaaccggttagggctgttttaggattgttagtcattcttggtttgttggttgaatcatttatttattcataaaatagta

SEQ ID NO: 1318 - DNA, 83 bp, Arabidopsis thaliana; identical to SEQ ID NO: 907

SEQ ID NO: 1319 - DNA, 86 bp, Arabidopsis thaliana
atgatagactcattttgatatgatctatgttatgcatgtgtttgtttgatactgctgtgaacttgggttattgacagatttgatat

SEQ ID NO: 1320 - DNA, 122 bp, Arabidopsis thaliana
acaatagcacgccatacgaacgtttgcataagaagcagcctcgatttgatcatctgtgtgttttcggaagtttgtgttatgcacacaatcgtcatcgtggtggtgacaaatttgcagaacgg

SEQ ID NO: 1321 - DNA, 84 bp, Arabidopsis thaliana
aaaatgatttccttgtggtttgcatggtggttttcctgtcttttctcatgtgataggatttgtcaataccttgtcggctttgaa

SEQ ID NO: 1322 - DNA, 82 bp, Arabidopsis thaliana
cgttctctttgtgatcttggttcttgtatcaatttgatgcctcattctgttgatgtaagacttgggatgacaaatttcatgg

SEQ ID NO: 1323 - DNA, 70 bp, Arabidopsis thaliana
attggttgaagtagatggttcaagtgtcggtaggctggtaaggtcattgacgatgatcatcatcttctta

SEQ ID NO: 1324 - DNA, 74 bp, Arabidopsis thaliana
attgttggttttgaagttgttgtatcctttgtagccaccctggttgttgttgatgtagctgacttcttccaact

SEQ ID NO: 1325 - DNA, 104 bp, Arabidopsis thaliana
gcgtgagataggcggtaccagcaacagagcgattactggtatgatttctgagactcagactttgtgaattgtttctgttgttttggatatcattgttttgtgat

SEQ ID NO: 1326 - DNA, 91 bp, Arabidopsis thaliana
cgtgagattaatgatagaggtgatgtgaagattagcagagtttcaatgaatgcaaatgttgctgatccttttacttaacctcttccacagc

SEQ ID NO: 1327 - DNA, 105 bp, Arabidopsis thaliana
gaaagaagtagtgaaaaaagaaattttgaaactgtttgatgttggtgtcatctaccctatatctgatagtacttgggttcttccagttcattgcgtccctaaaaa

SEQ ID NO: 1328 - DNA, 86 bp, Arabidopsis thaliana
aaataagaaagaatgaagctccagatctgaaaccagaaattggatttttctaacttaggttttgattttggagatttataagtggg

SEQ ID NO: 1329 - DNA, 89 bp, Arabidopsis thaliana
attcatttccgtgttatctttggtgttttcaggtgtatgacccgtagcaaaggctcatcacatctagtaaactaccacgaggatatcgg

SEQ ID NO: 1330 - DNA, 90 bp, Arabidopsis thaliana
cttaagttgagagcggttttgtgtgtgtccttctctgggtttcttgaggcgctttatataagattttgatagaccgccctcgcgatattc

SEQ ID NO: 1331 - DNA, 89 bp, Arabidopsis thaliana
attcatttccgtattttctttggtgttttcaggtgtatgacccgtagcaaaggctcatcacatctagtacactagatatcggaaggttt

SEQ ID NO: 1332 - DNA, 88 bp, Arabidopsis thaliana
aattggtctgttctgttgatccatagcagctggtctttgttgatcacaggttgcctttgctttggtgtcttctaactcacgagctatt

SEQ ID NO: 1333 - DNA, 89 bp, Arabidopsis thaliana
agtgggatgagctagggtgttagcatactgaggattgattatggagtgtttagtcaattgtttgttgttggagtcctagcatcatcttc

SEQ ID NO: 1334 - DNA, 121 bp, Arabidopsis thaliana
gatgaaggcaaggttcaaaaagtggttcgaaaagcaagttgctgcatgagtttgcctattcttggtttccagtttcagtgttattgagtttttgagcttttgagttgttgttcttatttct

SEQ ID NO: 1335 - DNA, 83 bp, Arabidopsis thaliana; identical to SEQ ID NO: 907

SEQ ID NO: 1336 - DNA, 91 bp, Arabidopsis thaliana
gcaaatgactgtaacttttgtcatgttgttgtagtagactgatagaccgttaatagtatactcaatgaagaagagaagagaggcacgtgcg

SEQ ID NO: 1337 - DNA, 123 bp, Arabidopsis thaliana
ttttgacgcatgatatgtaggcttagatctgattgcataggataaaattgtatgatgatatgatttgatgattattgtttgatatgtatgattatgatgtttgactatgatatattatgtatg

SEQ ID NO: 1338 - DNA, 79 bp, Arabidopsis thaliana
aaatgccacaggaactgttgttgttgaagctgaaccaattagagctgaggaggcagttgagactgaggcaaataacact

SEQ ID NO: 1339 - DNA, 89 bp, Arabidopsis thaliana
attcatttccgtattttctttggtgttttcaggtgtatgacccgtagcaaaggctcatcacatctagtacactaccacaaagatatcgg

SEQ ID NO: 1340 - DNA, 132 bp, Arabidopsis thaliana
cttttgttaatattttatgttctttggattcgtaggagatgatcgttgtgagtaatagtgtatgtgatatcatcaagtcgaacattgagatgatagagtcgtccactgtggatgtcagtctttctacagata

SEQ ID NO: 1341 - DNA, 73 bp, Arabidopsis thaliana
ccgctcttggtccagatggtatgttgattttcagttccttgatttcgatgtgtttctcattgagagtgtcttt

SEQ ID NO: 1342 - DNA, 103 bp, Arabidopsis thaliana
aaaaacaatatatatagaccctaaaaatgtccagggactaataatgcaaataggaaagtcttctagagcaaatttgatcttctggaaacttgaaagcgtctag

SEQ ID NO: 1343 - DNA, 106 bp, Arabidopsis thaliana
atcatgtggtaacagagcacactctgaaagttgagttttccatctttatcattttgtgtcttttcgtcttcagatctgtgtccgtctgtcaccttgatttaatttt

SEQ ID NO: 1344 - DNA, 80 bp, Arabidopsis thaliana
aaaagtatgtgtgtgaatgtaagctgaattttatgtctcttccaagtcgtccttgttcccttatataggtctacgcacgt

SEQ ID NO: 1345 - DNA, 132 bp, Arabidopsis thaliana
aacgtgtatttgagattagcaagacatggcgtttggagaagaggatgatggttggtagattatgtttaatatctgttggagtacatgggattcatcacggtttcagagtcctgttgtcgagtgctaaaagag

SEQ ID NO: 1346 - DNA, 73 bp, Arabidopsis thaliana
tttaagtaagagtctgagagagtgtgtgtagttttccatagggaaactactataaatgttgaactctacttta

SEQ ID NO: 1347 - DNA, 89 bp, Arabidopsis thaliana
tggggttgttggttttgaagttgttataccctttgtagccgctctggttgttgttgatgtagctgacttcttccaactggttaccctcc

SEQ ID NO: 1348 - DNA, 111 bp, Arabidopsis thaliana
tttctatgtctggcaggtgggaatatcttctggagctgctgcagccgctgcgataaaggtggcaaagcggccagaaaacgccggcaaactcatagttgtaagtaaaaaaac

SEQ ID NO: 1349 - DNA, 134 bp, Arabidopsis thaliana
gtttttctacagtgaggttcctgtaagaatgagaacaatgggatttgctctctacacaagtgtttttggtgttggaagctttgtgagcgccgcactgatctcaattgtcgaggcttactcgagctcaacaggtg

SEQ ID NO: 1350 - DNA, 134 bp, Arabidopsis thaliana
atgcaaaatgtacaaaaataatggtaaatgctatgaaagatggatgaaactagactcaaaatcatatatatgaaagttggccaactctctccatatgattgacacatcatcactttaacatttgccatgtgtcc

SEQ ID NO: 1351 - DNA, 131 bp, Arabidopsis thaliana
ttagtgttttaggaattaactgactataatcctactatcaatttggcgtcgttgccagtttggtgtttgtttgctatatttgagatcattagaaacagtatgatcaagtttgtttttgttacacaagttac

SEQ ID NO: 1352 - DNA, 89 bp, Arabidopsis thaliana
tcgatttgcttctcaaggtagatttgtgttcataactgttagatacactttctgatatatagatagatatacttccttgaggtatattg

SEQ ID NO: 1353 - DNA, 130 bp, Arabidopsis thaliana
tgttatcacccttctattacactgttgttatcatgtttttagcttgttcaacgtttatgctttctgttctgatgtctgagtagtgaataggtttctgaggatgggttagaatagtgtagaattctcagta

SEQ ID NO: 1354 - DNA, 130 bp, Arabidopsis thaliana; identical to SEQ ID NO: 1353

SEQ ID NO: 1355 - DNA, 125 bp, Arabidopsis thaliana
tttactaagttgttcatcctgttatcatccttctattactttgttgctatcatggtttcattcttatcatcgtttatgttctctgcaatgatgtttgagtagtgactaggtttctgaggatgggt

SEQ ID NO: 1356 - DNA, 95 bp, Arabidopsis thaliana
tgcaggctccagttgtgccacaagtggtggaggtgcagcaaagggctgcggttgctgagaaagttccatcttatttgaggataatggagcagttg

SEQ ID NO: 1357 - DNA, 80 bp, Arabidopsis thaliana
gtctaggactttgctgggccgaaactggtgttgatcgacaccaagagtgtgtcgatcaacactcctcgctgattcctgaa

SEQ ID NO: 1358 - DNA, 71 bp, Arabidopsis thaliana
catgggagattttcacgacggtgtcgacagacacaactctggtgtcgatcgacaccctctgcagaaccaga

SEQ ID NO: 1359 - DNA, 137 bp, Arabidopsis thaliana
aggtaaaatttaaaaatgtatcgcgtttattaaatttgttgatggttgtggattcgtgttgatggttgtgaaatgttattgtatgcaggttccattagagagttattgtatggtcatttgcgggaatgggaatgctc

SEQ ID NO: 1360 - DNA, 107 bp, Arabidopsis thaliana
ttaagacatcatggaggaggtgtcgaagttgaatgttgaggatgttgatggaatcttgcaaccacagcatctccttatcacggcgtgcttctcgttcttcggttgtc

SEQ ID NO: 1361 - DNA, 120 bp, Arabidopsis thaliana
agcttgtggagtaccgccgaaggaaccaaggttagaaccaagaatgatggatttagatcatttgcgttgatgtgagttcttggagtatgacatggttggcgacttctaccgctacaggtt

SEQ ID NO: 1362 - DNA, 83 bp, Arabidopsis thaliana
ggtttttgttgggccgaaactggtgtcgatcgacactaagagtgtgtcggttgacactcctcgctgattcctgaaccaaaatc

SEQ ID NO: 1363 - DNA, 132 bp, Arabidopsis thaliana
atttcaggatcttgtgttgttggggcttgttgtggttattgagtgaactttggtggtggattctgctgttggtatcctccattgaactgttgtttagggacataaccttggtggtggatacacttgatcttg

SEQ ID NO: 1364 - DNA, 89 bp, Arabidopsis thaliana
aggtagaatcttgcaaaggtagtggaagttgaagatgaaacaagagtgtctctctctcacactctataatatctttgtgaagagtgaat

SEQ ID NO: 1365 - DNA, 134 bp, Arabidopsis thaliana
aattgttgagataaagaagatgaacccaagaacaaagaattattgagaacgtacattgctgctgaagaagtgttgatcttgtttttgtaccaagtttggagccaaaacaagcattgctcgtgtaagtaatgaag

SEQ ID NO: 1366 - DNA, 132 bp, Arabidopsis thaliana
tcgtggatgagaatttgatcagtgttcttgaactctaatgttcttggggaatctatattttggatgattttatcttggggggttttaagaattggattagggattagaagcacactcattagtatttgtgag

SEQ ID NO: 1367 - DNA, 105 bp, Arabidopsis thaliana
atgggttatctgaagagcggtagccagaaatcgttgcttgcaggtggactgtcagctgctgttctgctgtatgtcttcagtcagctcccaacaaaacctgttctt

SEQ ID NO: 1368 - DNA, 112 bp, Arabidopsis thaliana
tggttgctactgtttttgaccctagaaagaagatgaaatttgttgagcttgctttggaaagatgtatggtttaggtagtgtggaggtttttcttctttctgattcagtgatt

SEQ ID NO: 1369 - DNA, 137 bp, Arabidopsis thaliana
aaataactttctgtgaaaaaaaaaaaaaacttgttaaaaaaaaaaaagtctgactaaacgtttgcttcttcttcttcacacaaaactgtagggaagaaaaggaataatggagtttggattagccacttcgagttttc

SEQ ID NO: 1370 - DNA, 92 bp, Arabidopsis thaliana
taatacttacgcatctcattttgttgttgatgcaggtaaagataaagtgtgatcgtggaatcatggcaaggaagagaggatgatgtaggaac

SEQ ID NO: 1371 - DNA, 130 bp, Arabidopsis thaliana
gaagaagaattaccgagatttgtgccttgagtctgtgatgtgatgagaattgttaaatgtaccattttttttttttttttttttggacaaaatttttccttcaattaaaattacaaaccggccggtacaa

SEQ ID NO: 1372 - DNA, 119 bp, Arabidopsis thaliana
ttcccactgccaactgatcttctagaatgctatatcagaatccaattgaattatgattatgaaatcatgatgaatatttggtgctttagggtttcagatttagcttaaccaatggttta

SEQ ID NO: 1373 - DNA, 97 bp, Arabidopsis thaliana
ctcgagttttcttacatagtgcctagtgagagtatctgcaagccttcctctgcttcagcttcttcatcatccaaaggttgtgagagtcaaaactcgc

SEQ ID NO: 1374 - DNA, 171 bp, Arabidopsis thaliana
ttgttttcttgcttcatgtggtgctttgcttattgtgttcttgccttgtgttttctggaattttgatgttgtggctcctgtagttgaggaagaacctaggaagaggaagaggaagaatttgatcctggctgagttactatagcttggggtctagtaataaggggaggaaat

SEQ ID NO: 1375 - DNA, 136 bp, Arabidopsis thaliana
atcaccatcaccaaatgcatacacgtttgtaattgtggtttacttgtcggctcatatttgtatgtttcttatatatatgaaagtggctgcagttgatgttgttgcaattccttctgaaacaaactatgtagctttt

SEQ ID NO: 1376 - DNA, 80 bp, Arabidopsis thaliana
gtgtcatttcttgcctccttatggtttccagcattggaaccaatgcctttgctcttgctttgatgatggtggaattgaat

SEQ ID NO: 1377 - DNA, 83 bp, Arabidopsis thaliana
aaatcttaatgtatatgtatgattgtgacatgtgattaaagtagtatcttctcttgatgcttcaggatctgcatcgttacaca

SEQ ID NO: 1378 - DNA, 127 bp, Arabidopsis thaliana
attcagattatcattgcaacatgatccaagtttgaagaaagcccgagaccatgttgttggtgcagtgcattgtagtgtgtcataagcagcttggttgtacctcttcaatacttctaagttagtcgca

SEQ ID NO: 1379 - DNA, 91 bp, Arabidopsis thaliana
gattgttatgaatttgttgttagaagttaaaccacgtgaggttgattgcgtgtgtctaagtttatatgttatgatgatggttgtatagctt

SEQ ID NO: 1380 - DNA, 108 bp, Arabidopsis thaliana
tacaccaatgtttagttagtagatccaacacatattattttgtacttataacattggatgtactaactaaacattggtctagtagttgtccaatcataaataaataaa

SEQ ID NO: 1381 - DNA, 87 bp, Arabidopsis thaliana
tatgttttgttatgtagttggtgctgatgttgatggagagagcattgagcttctattgaaagaagtgagtggtaaagacattgctga

SEQ ID NO: 1382 - DNA, 133 bp, Arabidopsis thaliana
aacatctccattttcttcatagttgttttcttcattgtcatcgctattctcttcattaatacttgtttcaggaggaaactcatctgatcgacattcttgatgaagaaaattatgtaatccagcacaagcaaga

SEQ ID NO: 1383 - DNA, 129 bp, Arabidopsis thaliana
gctcaaagaagctatcaaaggatcaaagatcgcgatcgtcttgctctcaaagaactatgcttcttcatcttggtgccttgatgaattagcagaaatcatgaagtgtagggaattgttgggtcagatagt

SEQ ID NO: 1384 - DNA, 122 bp, Arabidopsis thaliana
cgtatccacaccctttcttttggcttcatccatgaaaatcttgaggaatctaagtttgtgctcttcaatcatctgtagattcttttttccgtgatggtatgggccgagtgatacaactctag

SEQ ID NO: 1385 - DNA, 80 bp, Arabidopsis thaliana
actattacgaccgagtctaagaagaaccttagcacctctatttatatcatcgaggtctttggttttctaggttagtcttc

SEQ ID NO: 1386 - DNA, 134 bp, Arabidopsis thaliana
tttcaaacttataagtcttaccagttccttctttgttgttgctgactttggattagaggtggtctctttttctgtttagaaattatcagtagaacactaagacaatgtagggaataaatggcatctttataatc

SEQ ID NO: 1387 - DNA, 138 bp, Arabidopsis thaliana
gttttgggtgaattgttcaatgactgatttgtttgtattgtattcgtgattatacccttttatttgcttgtgtgtatagctcgtagatgggaggatcgcctcactaagtatttatgataatatttacgcatctcgttg

SEQ ID NO: 1388 - DNA, 88 bp, Arabidopsis thaliana
ggcatagaggatggtgaagaagcttttgccaaattaaaactcactactcttcttctgcttttgctactgtcacttgttccactctgcc

SEQ ID NO: 1389 - DNA, 130 bp, Arabidopsis thaliana
tcttgtggtgaggattgaaggttgtgaagtttttcctttagattgtttgatgcatttgtatttttgctatttttggaatctggaaacgctaaaagtataatattctcttgcaagttatgatatttacttg

SEQ ID NO: 1390 - DNA, 96 bp, Arabidopsis thaliana
atctctcttcctctttgtttgcattgcttatgtttgatattctgtgtggttttgccagactgggattctcttgagcaagtcgtttcttaaggagaa

SEQ ID NO: 1391 - DNA, 119 bp, Arabidopsis thaliana
agtatgccaatcgaatgttgccatgccgtaaaaccataaaatcacataatgatgttagtgaagatgatgatgatgatgatggtgataatcatgacaacagcttctttcatcaatgctct

SEQ ID NO: 1392 - DNA, 106 bp, Arabidopsis thaliana
attatttaggctcggagcttgttatgtgttgtacaaggcataaggttacttgactcttgttgctattgttgatcctagggcataactacattggttcagagcacct

SEQ ID NO: 1393 - DNA, 83 bp, Arabidopsis thaliana
cgtatgcatctatcatctatgtatgcttacatatgctgatatgcatgcatatgtcatgtgtgcatggagtgacggtatacatg

SEQ ID NO: 1394 - DNA, 133 bp, Arabidopsis thaliana
ggattaggtcataggataggcacgtcacgattattgcccccggaggttatgatggacatggttttggattatggtgctgatgtgtgggcttttggctgtaccgtgcttgagatgttgactggagaaagagttt

SEQ ID NO: 1395 - DNA, 87 bp, Arabidopsis thaliana
actaactctttagcattgttgttgatgactttaaacattgcagccaacagcagtaggtattgattatcatcagcttgaaaacaatgt

SEQ ID NO: 1396 - DNA, 118 bp, Arabidopsis thaliana
agactcagagactctgctgaggtaacacaaatttttcattttctaatcgatagaccattggtgtgtgagtgagtgactaagcgtggcattttttttcagagttttgggctcccactat

SEQ ID NO: 1397 - DNA, 96 bp, Arabidopsis thaliana
catcttaagagcaacttgtggtggatcatagtgatttttattggacacatttgaagttgttgaaatttgattccattcgggttgaatatatggaac

SEQ ID NO: 1398 - DNA, 130 bp, Arabidopsis thaliana
tgtttgagtttatgttgtctttgggtgtgttttgagtttgagtgttttccgtgtttgtgaaagtgtgtgttttcagatattgtgagtaaccaaaacaaagccaagatagctatgcatgacacaattgaca

SEQ ID NO: 1399 - DNA, 96 bp, Arabidopsis thaliana
tgtgtttgttgtgtttgttatgtctgtgaacgtgtgtgtttctagatagtgtgagtaaccctaacaagtcaagacataatagatgaacttatgcat

SEQ ID NO: 1400 - DNA, 130 bp, Arabidopsis thaliana
tcaccggagagaggtgcaattttgtagatcagtgctaatgtgattatttgtatatggtttcatgtctatatatcgatcaagaattcatagaacctctaacaaatgtatctctttttttgtagttcgatcc

SEQ ID NO: 1401 - DNA, 132 bp, Arabidopsis thaliana
gaagaaatctgggttaaagtgtgttcgtgtgttctctaaatttgattcactaaacgtgtgttcgtgtgttctctaaattgaattctgtgtagctatgaacttgtgagtcgctgtaaaattggatttgaactt

SEQ ID NO: 1402 - DNA, 97 bp, Arabidopsis thaliana
aaatctcgttctatattcatcacagctacgcatgtatgtttgtatgattagattaatatacattgagggggagagatcgtggagaaagagagcttac

SEQ ID NO: 1403 - DNA, 81 bp, Arabidopsis thaliana
ctatcgtcaatgatatcaagaaactgatggagttcatcgtattcatgatcagcttcttcttcttccactcgctgatgattt

SEQ ID NO: 1404 - DNA, 101 bp, Arabidopsis thaliana
ggttgagaggaagcatgacgaggaagcgaggcacatattgtataaggacgatcaatgaaagtgtgtggttctggtgagctgcgtatctgaattctccagca

SEQ ID NO: 1405 - DNA, 247 bp, Arabidopsis thaliana
acaacttcgcgttatttctgaaaacttcatatctattttcttttaggtcgagcttcattggaaccaaatggtggctcatccatctattactaaagctatacagcaggtggacaagccatcatcatgttcctgtgaagctcgatctaaaagactacagatttgagattttcaaaaataacatgaagtacattctccacacttcctcatgttaatcacttcattttatctctctatttcacaatctctc

SEQ ID NO: 1406 - DNA, 121 bp, Arabidopsis thaliana
catgttttgttgttacatcaaaatataagataaaaatgtgtttgatcgattcatcaaattgaaagaaagagacacaactttgactttgtggttttgatgtttttctaaatcatttaatttt

SEQ ID NO: 1407 - DNA, 68 bp, Arabidopsis thaliana
cacggggcttctggaaaaggttagttctataccgagctcttcttcttcctgaacaatccctaacatac

SEQ ID NO: 1408 - DNA, 73 bp, Arabidopsis thaliana
acaccaccacgcaaattaactcagtatatatatgtcaaatatataagtgtttgtatatgtgtgtgtctgtgta

SEQ ID NO: 1409 - DNA, 125 bp, Arabidopsis thaliana
ctgaaattagggttttaaaatttcgacatcagactggtaaaattgagcggttctgtgaaatgtttctttgattttacagtggaactaatgaatttgaaagcggatctgagagaagcagaggatga

SEQ ID NO: 1410 - DNA, 103 bp, Arabidopsis thaliana
gttattttcatgcttacatacattgttttgctgagtttggatatcttactgtctttgggatgttatatgtttgatgtttagtgaaaacccgtaaagaggcacg

SEQ ID NO: 1411 - DNA, 78 bp, Arabidopsis thaliana
tgatggttgtgatgatggttgttgttgtttttaggaggttcttcatttcttggaggtgaaacaatactctcaggtcct

SEQ ID NO: 1412 - DNA, 103 bp, Arabidopsis thaliana
gctgatctataattggaactggtaattgtgttgaatttgaatcatgttctatggagattgattttgatttttgtgatgcaattattgatgggttctgtgatct

SEQ ID NO: 1413 - DNA, 97 bp, Arabidopsis thaliana
aagaagaagaagtagaaacagaggaagaagaagaagacacagactcgattgcaccaatggtgggtgaatcatcatcatcatcttctgttaaaccaac

SEQ ID NO: 1414 - DNA, 137 bp, Arabidopsis thaliana
taaaggttttgtggtggatcctgttgtttatagttatctaatgatggggtgtgtgaagaattctgatgctgatggtgtgttaaagctttatcaggagttaaaggagaagcttggtgggtttgttgatgatggtgtgg

SEQ ID NO: 1415 - DNA, 72 bp, Arabidopsis thaliana
aaattggttctcatgtgtgtgtatgtgtgttcctaacgttttatacacaaaaacaggggaaattcaccgaaa

SEQ ID NO: 1416 - DNA, 108 bp, Arabidopsis thaliana
tagattatcttcccaagacgacttggatgaccctgattgttcatgcccttttgatttcgatgatgttgatgagtcaggacttcagtacaggttggctttatcccacta

SEQ ID NO: 1417 - DNA, 82 bp, Arabidopsis thaliana
tcgtctcgtgaatcttttggactctctttgattacgtagatagcgggatcggattgagtttgctggttgttatgaatgtttt

SEQ ID NO: 1418 - DNA, 102 bp, Arabidopsis thaliana
tctatcatctcttttgtgaacttcatctttgatgttttcatattcattttttctctctctctttcttcttttgatggctggctcacaagagtgggatactgg

SEQ ID NO: 1419 - DNA, 89 bp, Arabidopsis thaliana
tgttactgaacttatttgatgatgttgaatctttggagaatgtaattacatgaatgtgtagtaaacttcttggatgatgttaaatatca

SEQ ID NO: 1420 - DNA, 113 bp, Arabidopsis thaliana
tcgtttcatcagtaagatggatcatttggatggagatgagttttgatgttcgtttggtgccaaaaacggttcattcagatgatccatccaaatgaatcatctggatgagtttg

SEQ ID NO: 1421 - DNA, 117 bp, Arabidopsis thaliana
ttggaattgaatccggtggttaacgatagatttgggtgatgtcttgtgcttgaatcttactaagcgtttaagtatgaatcttaatttgtattggttcagtggaaatttggttgcttt

SEQ ID NO: 1422 - DNA, 101 bp, Arabidopsis thaliana
gtggtggtggctgggcccaccaacatgctgagactgcgtgttcttctcctgagaagattgttgttgttgttgttgtggtggcttgaagccaggaccatttg

SEQ ID NO: 1423 - DNA, 83 bp, Arabidopsis thaliana
gcaacgtttccttgtcacacagaagttacttcttccttctcttcagaggagatcagaaagattgcttgtacatggaggtcgaa

SEQ ID NO: 1424 - DNA, 110 bp, Arabidopsis thaliana
acaagctctggtgttacaatgtgacattaaaacacgaatcttttctcttgagaatcatcaatagagagagagagtgagtggtcatattagggttcataacttgcttgagg

SEQ ID NO: 1425 - DNA, 113 bp, Arabidopsis thaliana
cagcctggagacgaatttgagagaacatgtctttgtcttcattgttgatgttgtggacaggaacatgaaaagagagcggaagatggagacagagagctcggttgtctcagagt

SEQ ID NO: 1426 - DNA, 75 bp, Arabidopsis thaliana
gtgcttggcaagagtttgtggtgctagttctaatcagcacagtctgctacttcttcttcctcgagcaattactgg

SEQ ID NO: 1427 - DNA, 79 bp, Arabidopsis thaliana
tacgtgtgatgtgaacgcatttcagataagttaagtagatatatatcttgttgtatgtgtgaatgcatctccacatctt

SEQ ID NO: 1428 - DNA, 133 bp, Arabidopsis thaliana
tctatttcaactgggatttgtatgaatatttaggaatttacatctgcttgatataccctgctttttgtgttcaatggctgctattagtttatgtggatgctgtgtctcactatcagattttatagacgtagaa

SEQ ID NO: 1429 - DNA, 87 bp, Arabidopsis thaliana
caaaattccggctaaggaagagaattaggtgcatacttctttataaaagattcaaccagtgtctttctctcttctttaggaatccga

SEQ ID NO: 1430 - DNA, 80 bp, Arabidopsis thaliana
aaaagatacttgtgatgatcagtcaataatgtgttagacacctgagccaatgttccatattgttgattttgttgtcacca

SEQ ID NO: 1431 - DNA, 83 bp, Arabidopsis thaliana
caacggtagtagtaagtggtgttggcttggagaggtccgatcttgacatggtggattttgccggatttgtagaagaagtattt

SEQ ID NO: 1432 - DNA, 83 bp, Arabidopsis thaliana
taaggtggagaggttgagatgaaccagaggagaagaagtggttgttgtttggtccatgaccaagctcctcacctaagacaaaa

SEQ ID NO: 1433 - DNA, 108 bp, Arabidopsis thaliana
tttgtcttttttctgaattgaattttgatactgtttatgtggttttagaatattagggttttgaaagatgtgaaattgtagatttggactcaggggatagggaaaatg

SEQ ID NO: 1434 - DNA, 124 bp, Arabidopsis thaliana
atgtgtttgcttccttcttgtgaatgtgtttgtgtcactgttccttagagcgattgttgtgtggatatgagaaagacagaggaacatatggaggaaaacacgtgtgttatctatgaagcttatc

SEQ ID NO: 1435 - DNA, 109 bp, Arabidopsis thaliana
aaagtctatattctaagtgcatccttaaaaggcattttccatatatataagtttcatctttcgagaaaaaggaaaaaagactctttaagtgatgatttcaagagtattt

SEQ ID NO: 1436 - DNA, 99 bp, Arabidopsis thaliana
catagagcatggagctgaaagatgattctctcttcttcttgactcatcggtccacgcttcagagtcggattcagatagttcatccaccttagcctgcaa

SEQ ID NO: 1437 - DNA, 105 bp, Arabidopsis thaliana
ctcaaagaagtagtgggttggtaagatgggttcattgaaaaacacttgcatgtgtgtatggctctttaccacatcttctatttcttactaaacattcttcatttt

SEQ ID NO: 1438 - DNA, 76 bp, Arabidopsis thaliana
cccttgatttaatcacttcatggtgatttctaactgtgtttagtgatgacgatgttgatgattgatgtttaaggtt

SEQ ID NO: 1439 - DNA, 109 bp, Arabidopsis thaliana
ttcccaaactctgtttcccaatcatcaagctcttcctcgtacttcttcttcctcctcacgatgtagaaagcgaggaagatgatagagaagatcagagatagtgaaatca

SEQ ID NO: 1440 - DNA, 83 bp, Arabidopsis thaliana
ttaggggaactctgtttatcgattttgagcttcttcttcctctcagaaggagaagatgaagaacgagttgcagaagaaggaat

SEQ ID NO: 1441 - DNA, 145 bp, Arabidopsis thaliana
tggtatgtgcccaaatgttcccttactctgtagcttactattgatattgatgagtcatgagggttttaatatgttttgtttggttctagtatgtgcaatgttctgttttttattaagttatactattttaatggaactatttggt

SEQ ID NO: 1442 - DNA, 92 bp, Arabidopsis thaliana
gtcagttgttatgaggatttgatgaagtttgtggtgttgattacctttccatttttcagctataggccttcaccctttttcatacttgatga

SEQ ID NO: 1443 - DNA, 138 bp, Arabidopsis thaliana
aatcctgcattgttttttacgtcttgtttacgattcgcgtccctgtaaacttgctgtgtctatgtgtctgtatatataatgtcattacatgtaacatgtgggagtggtttagttagcttgttcgtcaatactaggcga

SEQ ID NO: 1444 - DNA, 88 bp, Arabidopsis thaliana
ccccatagtcctagtaaaaacacacacacgatggagaagaagattagtgatatggatgtgtttgtttgcagaggaatatggtatataa

SEQ ID NO: 1445 - DNA, 91 bp, Arabidopsis thaliana
cgtaagtttttccatgtaacgttgctgtgttatgatgcagccttttgtttttgtaagaacatagatcgttgttgttttgggattagacttt

SEQ ID NO: 1446 - DNA, 127 bp, Arabidopsis thaliana
ttattcgattctagttgtgtcgtggctaacttaagtgagctatatggatccatggaagtggtttttgtgtagatgaagttgttcttaaggctctaggggctcagtttcgagccatttagactcatct

SEQ ID NO: 1447 - DNA, 80 bp, Arabidopsis thaliana
tttttatctctctctctccaagcatttagtgtgtcataagactcatgattcactttgtatttgtagagacgagcttagat

SEQ ID NO: 1448 - DNA, 142 bp, Arabidopsis thaliana
ttagtggcagtcattgtttgctattgcaacatcttcaagattcagaaatcagattctcttatgggttttcttttgagcctttattttttggtttgagaatcttgatgatgctgcagcggcaattaaatggcttacttatcta

SEQ ID NO: 1449 - DNA, 83 bp, Arabidopsis thaliana
tttccagtttggcgtcgggagcttcgcggtggcggaggaggaggccgtggtggcggtggaggtcatggtggaggaggtggtga

SEQ ID NO: 1450 - DNA, 84 bp, Arabidopsis thaliana
aaatcattgcttagctgttgtttgtgatttgtgaacactaaacataagtcatcgacaaaagttgtggtgatcatagaaacgaat

SEQ ID NO: 1451 - DNA, 73 bp, Arabidopsis thaliana
ttcttcttcttcttcaactttgttaggttttgtagctttaaaagaagagtgaatttgggaagaagagaaaaaa

SEQ ID NO: 1452 - DNA, 94 bp, Arabidopsis thaliana
gtcttctgaatccagagccgagcagcagaagcagagtggaatatggaactgtttgtgtctctctgtgttccatggattcaagaggacttgcata

SEQ ID NO: 1453 - DNA, 104 bp, Arabidopsis thaliana
ttcttcttgtttctgttggtgcgtcatgaatccattttgtgtgttcttctgtcaatgatcacgttacaaaatcatgaaacaggtttatggtggaaaacataaat

SEQ ID NO: 1454 - DNA, 78 bp, Arabidopsis thaliana
aaacgaaactatgataagtgcagagacagatttacaaagcaaacctaaactctgtgtctgtgtgtgtctgagtctctc

SEQ ID NO: 1455 - DNA, 70 bp, Arabidopsis thaliana
ttgtgtagttgtgtgtatgtatctagaggcgttaagcatgcatacatattactatatgtcaacaaaaatt

SEQ ID NO: 1456 - DNA, 124 bp, Arabidopsis thaliana
ccttgaaattgatggtttgtacttgttggatgatgatcatgtgactgtgatgaatgtagttttggtgattggaaatcttgcaattgtatagcttctccttgtttctacagtgtgtttttgtttt

SEQ ID NO: 1457 - DNA, 86 bp, Arabidopsis thaliana
ccagagttgttcgaaaggaatgaagggagctcgtatctctactttggagtgacttccaattctcttttgccccatccctttggtga

SEQ ID NO: 1458 - DNA, 127 bp, Arabidopsis thaliana
atgacaacaatgagatctatgagaaggctgttaaaattctggagacatactggcttgaagaggaagatgatgagacacagcaacctccaggtgttgatggttctcaggctgggttccagtttggagg

SEQ ID NO: 1459 - DNA, 89 bp, Arabidopsis thaliana
aaaggtaaacacaaatccatggtgtttcttcttctatttgattgcgtttatagacgttagggtggggtttaccggtgttcttgtgactc

SEQ ID NO: 1460 - DNA, 107 bp, Arabidopsis thaliana
gaagttgctgctgatgaattgggtatgagtttgacagaagagagagagcacagcttgaatctgtgctattgttgtttatcatctctggacatgtagtaaagcttgag

SEQ ID NO: 1461 - DNA, 73 bp, Arabidopsis thaliana
gatgatgatgatgattgtggttattgttgtgtacgtcgtcgttgaacatggacatgaattgctcgtcgtcaaa

SEQ ID NO: 1462 - DNA, 93 bp, Arabidopsis thaliana
gtcaaaggagctcttgtcgaggcaaagctgaaacgattttgaagaaaagttgcagcttgtagtgttgtggatcactgagacaactcaatttct

SEQ ID NO: 1463 - DNA, 89 bp, Arabidopsis thaliana
attttgatgatcatgatgataaggagccttagtagtgtctccatagtaactattagggttttctgatgttggtgaatcagcaaaaatca

SEQ ID NO: 1464 - DNA, 109 bp, Arabidopsis thaliana
ttcaaggggattaagcagattggtgtgattggctggggatctcaggtacttaccttttttggtctctttatctgtagctactgtgcttcttgtttgattgctttttaaa

SEQ ID NO: 1465 - DNA, 84 bp, Arabidopsis thaliana
aggaggagcaatcatatggtataagccggagtggaagatccttgatttgatatgcacattggttttctctgtgattgtgttagg

SEQ ID NO: 1466 - DNA, 83 bp, Arabidopsis thaliana
agagagagagaggtataagagaagaaggtctagggttttaaatggttcgttggtgtggttaagtctctctctctctctctcaa

SEQ ID NO: 1467 - DNA, 100 bp, Arabidopsis thaliana
tgcaattgagtgatgatctagttgatttgacttttgttgcaggtacttaatttctgctgcaaaacaataccgcttttcaacaacctgacttacttaacta

SEQ ID NO: 1468 - DNA, 113 bp, Arabidopsis thaliana
gaaacgatggctaacatatgttgagctgttttgcgaacattgactttcatacaaactctctgtgtgtcatttttgtctcccacagtctcaccgtgagttgatctagattcttt

SEQ ID NO: 1469 - DNA, 110 bp, Arabidopsis thaliana
taaaaataattagacaaagagatttgactagtcacttgcttgggtgttgtaagtcaaacaacatggagaagaaggactaatcaatttacctctactatgattaatgtatc

SEQ ID NO: 1470 - DNA, 83 bp, Arabidopsis thaliana
attaaagttactgcatttgatctctctttgaactgcttctgttgttcaaggttccaaacatgctcagactcagtaattgaata

SEQ ID NO: 1471 - DNA, 82 bp, Arabidopsis thaliana
gagtggtacagggccatcggtttcgtgtttacttttgctagagtgtttgtctctgctggacttgtgcttcttctccttcttt

SEQ ID NO: 1472 - DNA, 75 bp, Arabidopsis thaliana
caatgttgtccatgattgatgatgataatgaatcgcaaagaaccaagatcagtcaatgatcaaaaccacattgta

SEQ ID NO: 1473 - DNA, 75 bp, Arabidopsis thaliana
aaatgtaagtcttggagagagaggagttgatagaatcgtcaccattgcttctccctccggcgattcctgcaaaaa

SEQ ID NO: 1474 - DNA, 134 bp, Arabidopsis thaliana
acagaggatttgaataagttagagttagagtttctgttcttgatgggatttaagctacatgtgaatgtgagtgtgttcgagagttattgttgtcatcttgaaagagaggttagctttggaggaggttatcagat

SEQ ID NO: 1475 - DNA, 116 bp, Arabidopsis thaliana
aagaggaaagctgaggctttaaggatcagagagaagtattctgacagagtcccggtattcttactctcttcttatgtcactgccatcgattttgttctgtttcctagttttcctga

SEQ ID NO: 1476 - DNA, 84 bp, Arabidopsis thaliana
ctgttcttcaagtcttgagcatttgtgatgttggagttgactttttgaaagtgcgatctcagacgttaaggagcttgagtctat

SEQ ID NO: 1477 - DNA, 137 bp, Arabidopsis thaliana
gtagatttctccttgacatgccacttgctctgtttttctacgtattgctgttttacatgggatgatgatgatgatcaaagtcttcttgagcatcactgggaatcaaagtcgggtttcgaagggtattcaagtccctg

SEQ ID NO: 1478 - DNA, 130 bp, Arabidopsis thaliana
tagagagtgatcttgttctggttctgagtgatggtaagaccaatatacatgtgttttcatatacattcacacacataattatgaggtctaagtcacttttctacgagcaggacgaatcgcagagtttgat

SEQ ID NO: 1479 - DNA, 117 bp, Arabidopsis thaliana
attttcaggggttgtttgttatatatgaaaacaatgagtagtgatgtcttgttggtttcagattccaggagaaccaaatatatcttacatatgctcaaggtattacagagctcctga

SEQ ID NO: 1480 - DNA, 102 bp, Arabidopsis thaliana
atgagggtatttgtaatatatgtgacatgtaaatatcatctctatatatatactgtatgtgtgaagttgtgtgtctacgtgtctaatatagcaaaaaaagtt

SEQ ID NO: 1481 - DNA, 89 bp, Arabidopsis thaliana
tcttactgttgccttatgtttgcagcggctgatgtgttcttgtggagggacaaaaaactctcagcttctgttcttggtgtagcgactgc

SEQ ID NO: 1482 - DNA, 119 bp, Arabidopsis thaliana
cattctacaaatataaccagatgatcaagattcttgttttctttgcaatttcaaaaggatgcagcagcagctggaggagaattcggaatattagaagggagatcatttgcgttgataca

SEQ ID NO: 1483 - DNA, 112 bp, Arabidopsis thaliana
aaaagttaccattcatcacaactatgagaaaaaatgtggtttatatttgttattggatgtacaaaacgtgtcacattttgtgttcatggtggtggtggtggcaggaataacg

SEQ ID NO: 1484 - DNA, 177 bp, Arabidopsis thaliana
agaggatttaaagagggatttttcttttgaggggactgttgtctggctcgaggactcttattctaatacaatctcatttgaatacattcagatctgatgattgattagggttttagtgtcgtcggaccaggcttcattccccccaattatcactccctcacaatccgaattaacgaa

SEQ ID NO: 1485 - DNA, 101 bp, Arabidopsis thaliana
attaccacaacaaccatcatgatcatcgtcataatcaaagtcataatcatcttgttggatgttttagagcttgatgatgatgatgatgcaagcaagcaaac

SEQ ID NO: 1486 - DNA, 60 bp, Arabidopsis thaliana
ataatgggattagggagacacaacacatgtatgtgtctgtgtctgtttgtgctgtaaaaa

SEQ ID NO: 1487 - DNA, 93 bp, Arabidopsis thaliana
tatcgcgatcggagtccgtcatctccagatctgtgtgtatgcgcttaatttcgttatggatgtgacatgatttcttgtgattcgtttccttag

SEQ ID NO: 1488 - DNA, 110 bp, Arabidopsis thaliana
caatagacaacggggaaggaaatggaggtgacaggtgatttgtagtaaaatgtcgtttgttctgtctctctcctactttgttcttgtcttgtaccaatatagtgaatcta

SEQ ID NO: 1489 - DNA, 99 bp, Arabidopsis thaliana
aaagagaggctaagtaacagaaatagtgatgctttgatgatgaatggtgattttatgcacatacgttgtggtgcacacattcttaacttgattgccaat

SEQ ID NO: 1490 - DNA, 84 bp, Arabidopsis thaliana
aagggttggtcatgaagcagttgttgttgttcactggcaggcaactggttgatggatacgggatattgttcatgaaatatgatc

SEQ ID NO: 1491 - DNA, 95 bp, Arabidopsis thaliana
cgctgagagcgaattgaaggagtgggtcactgctgttgtgaagcttgagatcaatgaggatggtggtgctgatgttcactttgagccgtttcaga

SEQ ID NO: 1492 - DNA, 104 bp, Arabidopsis thaliana
gttctgtacagacggtttcttttggttttgccagctttctttgctgctcctagtttgctaagctcggtcagacctgaatcagaggatgatcgttggatggttgt

SEQ ID NO: 1493 - DNA, 72 bp, Arabidopsis thaliana
atctcatcatcaccatcatcatcatcatcatcatcatgcttttatatatgattttgaatttgatgatgattt

SEQ ID NO: 1494 - DNA, 127 bp, Arabidopsis thaliana
gtgtttgtcagatggagcggtatgaagtcttggagcagatcgggaaagggtcctttggctctgctcttcttgttagacacaaacaagaacgcaagaagtattctattctctctcattcattcattct

SEQ ID NO: 1495 - DNA, 135 bp, Arabidopsis thaliana
aaatcctcactgggaaagctgtggttcgatgaggctggatcaaaactggacttgcaggaggatgatgatgatgctttcacaaatcttggtggtgcttttaaagaactcgggttctgcatgagggagttgggcttg

SEQ ID NO: 1496 - DNA, 154 bp, Arabidopsis thaliana
attttgaagacaagtccacaagggaacaagtgaagctgccagcatgatctatctttggttaagagatgaatgtggaaacatattgcttaaacccaagctaggtcatgctctgacagcctcactccttcctggtttaggaccattcattgatgaa

SEQ ID NO: 1497 - DNA, 74 bp, Arabidopsis thaliana
gtgctgcagaatctgctgatgctggtggctcaaccttgataacgattactagaattgggatagttctgcagctc

SEQ ID NO: 1498 - DNA, 143 bp, Arabidopsis thaliana
taatctctcataccttttccattctaattcctattccattattgtgtttgtgtttagtctagcgagagagagtgatgatgctgatactaaggagattttaagtgagctaattaaagagtctctcaacaccacacaatacaact

SEQ ID NO: 1499 - DNA, 115 bp, Arabidopsis thaliana
ttagtaattttgtctcagtttatgcttgtttttcgctggttgatttcagctgaataacgagtttgtgttgttgttgtcatcacaggtgatccatgaaacaggggagctcgtggct

SEQ ID NO: 1500 - DNA, 103 bp, Arabidopsis thaliana
atacactgttgttatcttgtggtcctagattatttatatgaaaggctaatgatgaagtgctttggatgatgtaatgttcatagggggtttctgcggtgaaagc

SEQ ID NO: 1501 - DNA, 118 bp, Arabidopsis thaliana
cttttttttcctccttgttgtgagtttctctactcttcatgttgttgttgttgttctgctctactaaaagcagagagtctttgtaataaaatttgtgtgtttgagatttcgaaataat

SEQ ID NO: 1502 - DNA, 87 bp, Arabidopsis thaliana
catgtcttgatgcgaacaccattgtcagtgttcttgatgaggcatttcctcacggtgactccttttactggttgctcattagggtat

SEQ ID NO: 1503 - DNA, 108 bp, Arabidopsis thaliana
acttgaagaaagcatcaagatggagaccattacgatgaagaagagaagatgcagaattgataattgactgtgcatcttctctggtggctttatcttgtttctgaacat

SEQ ID NO: 1504 - DNA, 135 bp, Arabidopsis thaliana
tcctctccgatgaattgtacttagagactcttggtttagtactactctttggttgtgaatctttggatttcttcttcacagactgttacagatcaagaacaatagaaaaaaaagtcagagagaaagaaaactctt

SEQ ID NO: 1505 - DNA, 137 bp, Arabidopsis thaliana
ggatcagtttcttcgctccacaccaacttctcttctccaaatataatggttccatgcgccggaggtggtggtggtggaagcatcggtaatcacggcggtggaagtggaagcggaggaggtggtggtggttatggagg

SEQ ID NO: 1506 - DNA, 121 bp, Arabidopsis thaliana
ctccacaccaatttctcttctccacatctcgcgaaaccttgcgccggaggtggtggtggtggaagcaccggtaataacggcggcggaagcggaagcggaggaggaggtggtggttttggag

SEQ ID NO: 1507 - DNA, 82 bp, Arabidopsis thaliana
atgttgctggaggaatgtcgtttgttttgttggcaaggatgacgggatcacagtcggtggaggagaagacagagatttcaga

SEQ ID NO: 1508 - DNA, 133 bp, Arabidopsis thaliana
actctttcctcttcaatgtcggcctcattcttctttgttcaatcaggtaagtctctctggtctcttcttctgcctttgtatctgttgggatcaagtgcactctgataaacggatctagatcaagcatgtttat

SEQ ID NO: 1509 - DNA, 79 bp, Arabidopsis thaliana
tgagaacaagattggcgatatctgttgttcttgtgtcgacattgttgttgttgaatgtgaaagcgaagagcgttgatcc

SEQ ID NO: 1510 - DNA, 87 bp, Arabidopsis thaliana
acagagagagaaagtgagtgtgtctgtgagggcgaatcaatgtctctgctttctccagaagatgatatttactttttgtgtcaatta

SEQ ID NO: 1511 - DNA, 72 bp, Arabidopsis thaliana
ggtgactggctctggtttggttgctgtgaaggggagcaccctttttccagggccagtagagcatcgtgacat

SEQ ID NO: 1512 - DNA, 142 bp, Arabidopsis thaliana; identical to SEQ ID NO: 512

SEQ ID NO: 1513 - DNA, 125 bp, Arabidopsis thaliana
tacaaaaaaaaaatgcagatacaaattaattcacagaccttaacacacatagggtgagagtgagagtgagaatactactcacgtatttccaacttttgaacctatgaaacctccgactccatcaa

SEQ ID NO: 1514 - DNA, 113 bp, Arabidopsis thaliana
ggaattcttcagttgattggtgttgatgttggaaaagggcttgatcttcctctctaattctgatcttcttcttcgtcttccaatctggtcatacaaatgtcacaaactctttt

SEQ ID NO: 1515 - DNA, 75 bp, Arabidopsis thaliana
gagaggggaaacatttggaagggattttgttggttggtacagctaagttatgacttaaaatgggttcttctctag

SEQ ID NO: 1516 - DNA, 64 bp, Arabidopsis thaliana
gtcgaagttttgatctttcctgacttgagaagaactcagagagagagagagagaggaatttgga

SEQ ID NO: 1517 - DNA, 82 bp, Arabidopsis thaliana
aggaggcttcttcttcttcttcgacagggtcacagctgtgtgaagttgaagttggagagagagatgataaggagatgaagag

SEQ ID NO: 1518 - DNA, 107 bp, Arabidopsis thaliana
aggatgaagaaaggctagatgatgtaggttatgatgatgttggtggtgtcaggaaacagatggctcagattagggaacttgttgaacttcccttgaggcatccacag

SEQ ID NO: 1519 - DNA, 105 bp, Arabidopsis thaliana
aaaacgtaattgcatagacacaaagatcacacagccaaaaccagttcatcaaaaaattgctgtgtgtttacatatctcagtttttgcatttactcatgttttgaa

SEQ ID NO: 1520 - DNA, 86 bp, Arabidopsis thaliana
tacgctaatcacagatatcagaaaatgcttctcaagggataaaacacatgtttgagtgtttgagtgcatgtgtgtgtaggtgaaga

SEQ ID NO: 1521 - DNA, 63 bp, Arabidopsis thaliana
tcggagaagatgaagaagacgacatgtcggatttctgatctgggttcttcttgttcatcttcg

SEQ ID NO: 1522 - DNA, 131 bp, Arabidopsis thaliana
gtatttatttagagagagacgttcgcatactattctttggaagagagagacgtaatttggtattgttggttaagagagagaaagttactaagtcttgggatgtattcgatcttcttagaaaggggaatgag

SEQ ID NO: 1523 - DNA, 134 bp, Arabidopsis thaliana
agagcaaagcggttgagttcggtgggtttcagacaagcggcccctccattgtcatccacactctcctcttcttcgccttcatcaccatctccctcatcgcccttcacatccacatctacgccgcctaattaacc

SEQ ID NO: 1524 - DNA, 88 bp, Arabidopsis thaliana
aggataatggccttgttttatgcatatatgtcttatgtgtgtgtgtgtgaacatgtcaaaaggtcacttatcaaccaaacatactaaa

SEQ ID NO: 1525 - DNA, 118 bp, Arabidopsis thaliana
tttacaccagcaaaacgcttgtgaaattgaatcttatgggcaagattcttgttgatgttccttccgcggcttgcctcccgtcccttcaatcgctgctccttgtcaatgtggtgtataa

SEQ ID NO: 1526 - DNA, 101 bp, Arabidopsis thaliana
acaggaacactctgcaaaattgtaaagtgtgatgttgtagtttcagactggtgttacaaacatacattatagacaacatgttcacagaggattctttgctt

SEQ ID NO: 1527 - DNA, 135 bp, Arabidopsis thaliana
cttctcagaaacagcctctggtgataatctgttttcttctacgtttttgcctttctccaatgtctgtgtgtgtttcatagcagctactattggaaaagcaatgttgctggtgtataagaggtcttctgacccttc

SEQ ID NO: 1528 - DNA, 112 bp, Arabidopsis thaliana
tattttatggatttgattttgctttttaagtgatggtgatttttcttagttagatcttattaattgatggatggcttttcatctagctagctaggtagaatatagatgtaca

SEQ ID NO: 1529 - DNA, 93 bp, Arabidopsis thaliana
agatccattagcttggagagacactcagaatcaatacaattctaataatcagtgatctgtttttgttgtgaatgtgctcagcgatgaatcgaa

SEQ ID NO: 1530 - DNA, 128 bp, Arabidopsis thaliana
aatttcttgactgggaggattccagagagtttggggaaatgtgctggtttaaggtcgttgttgttgtatatgaatacgttggaggagactatccctttagaatttgggagtcttcagaagcttgaggt

SEQ ID NO: 1531 - DNA, 68 bp, Arabidopsis thaliana
caagaaaaagcagattgaggaagaaggtatgtatattttgcttttgttcttgttttgatttttcttat

SEQ ID NO: 1532 - DNA, 95 bp, Arabidopsis thaliana
ccatacatttttcgaattgtttctgaaagtagtgagcttgatttgttcattcatcaggttgatagatcgatcgattgattttatggattgttatg

SEQ ID NO: 1533 - DNA, 106 bp, Arabidopsis thaliana
tgccgggaggagacaacaatgacgggtctgcagtggtggtgggccgagcatcattcaagatcttcttcatcttcaacgcactcgcgttgtttacgtctctggcggt

SEQ ID NO: 1534 - DNA, 69 bp, Arabidopsis thaliana
tctagatgataaacgagccaactctgcctcgtctgaatcaggttgttcgtcatcatcgtcattatcctt

SEQ ID NO: 1535 - DNA, 131 bp, Arabidopsis thaliana
ctcttaagaacaaaacattggacccacttttgatttagcagttagcaccgacatgtgtcttgctgaagaagcatgtttcatgcactggctctctgtcgtcactctgtcacatcttgttgttacgtgttgtt

SEQ ID NO: 1536 - DNA, 82 bp, Arabidopsis thaliana
cagaagaaccgtagagagaagaaagaccggtttttggcggcagtggttgttgcggcggaggaggagctggagatacggtgga

SEQ ID NO: 1537 - DNA, 122 bp, Arabidopsis thaliana
ctttcacttattacagaattttattacaaaacatctcctgaatctgattcttatgtgtggttgtgtaggacaacatttcaagtatcataactaccatcgaatcgaataaggtaacggaggaa

SEQ ID NO: 1538 - DNA, 75 bp, Arabidopsis thaliana
tgtccgacggcatctttcattgtgtttttcaataaatcttagtttagtgtttacaagaaatgtgtctggacatca

SEQ ID NO: 1539 - DNA, 75 bp, Arabidopsis thaliana
tggggagagagttggaggagttggggagagaacgttctttccagaagcatctagaagctttcaagattctccata

SEQ ID NO: 1540 - DNA, 76 bp, Arabidopsis thaliana
catatttttgatattggtgtgtctcacggcatgcaatggcccactttgctggaggctcaaagcaataccacaagga

SEQ ID NO: 1541 - DNA, 106 bp, Arabidopsis thaliana
tcatcactccgatcatagcgtagtgaagagaactcatctactccggttgagtatgagcaagaggaagaagatgaagatttgactgatgcgctggagaaaagtgaag

SEQ ID NO: 1542 - DNA, 69 bp, Arabidopsis thaliana
acacgttccttgatggtgatgctgacatgaccatcgttgttgttgtcatgatcatgatcatcatcatga

SEQ ID NO: 1543 - DNA, 77 bp, Arabidopsis thaliana
agagtaagaatctgccgagtgggctaacatttgtgttggaactaaactccttgttagcttgtttcattttgttctct

SEQ ID NO: 1544 - DNA, 76 bp, Arabidopsis thaliana
ttaaactagagaactaagatgatcgatccagtgatgatgaacgagtcatcatcatcatcttcttctagtagtaatt

SEQ ID NO: 1545 - DNA, 103 bp, Arabidopsis thaliana
acagagagtttcatagcttctttgcagctggttctgtgattctctatatggttatggctttatggagagttatgtttgagtggaagattgaagatcttgcttt

SEQ ID NO: 1546 - DNA, 63 bp, Arabidopsis thaliana
aaagaatgacgtggcgaggataaaatcgcattcgcctctgtgtgtgttctcaagtcattcaaa

SEQ ID NO: 1547 - DNA, 77 bp, Arabidopsis thaliana
ttctaatgcattgttctgtgatcaagtttcctaaatggataaatttccccatttggcaggctgttgatttgcagaag

SEQ ID NO: 1548 - DNA, 85 bp, Arabidopsis thaliana
ctctctggctgtgtgtcattgtggttgttcttggattctaaggaggtggaggaaataatggcggagacattgccggagagatcag

SEQ ID NO: 1549 - DNA, 132 bp, Arabidopsis thaliana
tttttctaaaatttattttaatttaatgttttcgtattttattttaatttaagtgacgtattgatgttgttgcgaatctagtacaacactgctgtctaatttaatgctctctcgttaggttttgaacgtagc

SEQ ID NO: 1550 - DNA, 122 bp, Arabidopsis thaliana
acgagatcacgtgcgcttagaccgcgtagcttccttagtgtttgctttaagctctctatgctctctgatgtagccgctgattcgcttgtggtagaagtaactgatgaagatgagccaaggac

SEQ ID NO: 1551 - DNA, 130 bp, Arabidopsis thaliana
aagtgttctatgaaagaaactgtttgttttctgaaacatctctcttcacggcaactgatatgtttgttcttgtgggcagatcaatgttctcttcacatatataaatcattttccagtcatagaaatcaaa

SEQ ID NO: 1552 - DNA, 122 bp, Arabidopsis thaliana
tgccttcctatttccttgtgctttaatttcggctcaattgttaggtattcttgatcttatttttgtgatctcagaattttgatccaagctcttggtttttctagcattaggtctttttccat

SEQ ID NO: 1553 - DNA, 138 bp, Arabidopsis thaliana
agattccaacaattttttcttccaaaagtacaacttttttttgcccatttcgtaaattcatatgtacatatatagttgaatgttgtgggtgtacgtaattggtaccattaaaatcaggaaatcacaaccttaaaaata

SEQ ID NO: 1554 - DNA, 124 bp, Arabidopsis thaliana
cattagcattacaacggattggtgacacaaaataattggttctaggtttatgtttatgctcttttgtttgctcatttagttgatgttatcaaataattggttctcggtacgtgctttcatttaa

SEQ ID NO: 1555 - DNA, 75 bp, Arabidopsis thaliana
ggtgctggcggtggtgctggtgggggtgccgggggaggattcggcggtggtgctggtggaggtgccgggggagga

SEQ ID NO: 1556 - DNA, 106 bp, Arabidopsis thaliana
tgttttctctctgcttcaagccattcgggcacgtctgtgataattccgaagctggatcgggtggtggtggtggcgtttctggtggaaccggcggtgaaggcaaaga

SEQ ID NO: 1557 - DNA, 91 bp, Arabidopsis thaliana
tatttacaaatgattcgttgacttgtgagttcttggactaacaaagtcttgaacttataatttgtatggtttgagaagttttattttagtg

SEQ ID NO: 1558 - DNA, 135 bp, Arabidopsis thaliana
tcaacagagagacgatgacgaagacgatgaagcaaaatttcgaaaagttgaatgatcagagagagagtgtgtgtgaggtctcaacggactgagcaaatatttattttatgttaattggattttaaagagaaaaag

SEQ ID NO: 1559 - DNA, 68 bp, Arabidopsis thaliana
agagaagggtttgtgtgattgtgtcggtgaacataattagagattatacacacacaggctgtctcttt

SEQ ID NO: 1560 - DNA, 112 bp, Arabidopsis thaliana
cttgcatttttcacagtttcttgtttagatgaattaggttttgttgttgattctgtgacgaaattgaagcattaagttagaactagaatctgagattaagtgagttctgtga

SEQ ID NO: 1561 - DNA, 101 bp, Arabidopsis thaliana
atgcatgcctattacgccatgcaaatagatacacacacacatagttgtgcctctgactttgtctgcaagtacgtttgtatggttctagacagtaattattg

SEQ ID NO: 1562 - DNA, 101 bp, Arabidopsis thaliana
ttgcaatgtagcctgttaaacatttcttggtcttgttttcatgttgcagcaatgatttttcaaatgtagcagagatctcactcaagtgttgtgccgttgcg

SEQ ID NO: 1563 - DNA, 125 bp, Arabidopsis thaliana
ggtgcggtgaataaagatttgacctttttcgtgaaatctttcggggaattcgatttggatggattgttgaaggcttcagctgaggttcttgggaaaggaacagttgggtcgtcgtataaggcaag

SEQ ID NO: 1564 - DNA, 63 bp, Arabidopsis thaliana
aaagtcgctactgtttccattcataccgcctgagactggcggtggtggtggaggcggcgatgg

SEQ ID NO: 1565 - DNA, 220 bp, Arabidopsis thaliana
atatcaaatctgttgaataagcattgtcggcacttgagaatgtaaagtgatgatcagctatcgtatttcatgtcgtaatagtagtcacgttagggtgatataacgaggcgagagttatatcatcatagtgcgatttctattatgacataaaatacgttttggattttaaaacacttgaccttcttaagtgctgataatgcttctttcttatgttttgaaa

SEQ ID NO: 1566 - DNA, 127 bp, Arabidopsis thaliana
agctttaagattttgtggttttctgcttccttgttattgatctccaggttgcagagttgcttgcttgcatggcaaagaatcctcaactttctttctctaagattgtggaagtggttgctgaaacaac

SEQ ID NO: 1567 - DNA, 62 bp, Arabidopsis thaliana
aatagccttgtgttgctggtgctggtgctgttgataagacccgtattggtgaagctgaggat

SEQ ID NO: 1568 - DNA, 89 bp, Arabidopsis thaliana
gaatcgaaagaactataatggtcttggagagaaagagagacgattcaagatcttcaaagacaacttgaagtttgtcgatgaacacaatt

SEQ ID NO: 1569 - DNA, 70 bp, Arabidopsis thaliana
acagatttgtggttgatgttgcaggaagtaatctggtggaggaggctgcaacaactacaaactaaagagg

SEQ ID NO: 1570 - DNA, 87 bp, Arabidopsis thaliana
agatacttgtgaagcgtgatgagttgactcttgaagtatgtttcttcttatgcttctgtatgctcgttcatgtttacttttacagta

SEQ ID NO: 1571 - DNA, 116 bp, Arabidopsis thaliana
aaagaaaaatcatttaaaatcaatttgcattaactggatttatttccaaaggtgtggtattgtgtttatatatgtggagttgttggctagtaatataataaggaaaagagtgaaac

SEQ ID NO: 1572 - DNA, 84 bp, Arabidopsis thaliana
aagaagtatttgctgtcttgaccgataccttccacaagcctgggttcaagttgcatgtgttggtgttgcagcacttatttagcc

SEQ ID NO: 1573 - DNA, 87 bp, Arabidopsis thaliana
ctttgtaagccaccatgttcatcatcatggtcagaagccatagtaacttcaagtccttgatcttgatgatgatcatggtgaccctct

SEQ ID NO: 1574 - DNA, 88 bp, Arabidopsis thaliana
ttctaaactaaagttaggagatgaaaacagattgtgtttaattgatgcacgcgtgcgtggtgatcttgttgtggttcctgattacgaa

SEQ ID NO: 1575 - DNA, 103 bp, Arabidopsis thaliana
tgcagacattatcgttttatcgtgtgtgtcagtgtgtgtgacttaaactctatttaaaagcaaattattgtactatgtatttcacaaatgatgatatgtttgt

SEQ ID NO: 1576 - DNA, 126 bp, Arabidopsis thaliana
aaaaagtaaaaaatttattaattgtcagtgcaatattgttcttgattttggtgtctatatttatatgacagattagaaggagatgtccaaaaaacaaggagaaaataatatggtacgataactgtg

SEQ ID NO: 1577 - DNA, 99 bp, Arabidopsis thaliana
gcaggacttatcgcttaaaaattgcactgtgtgtttggactggattatgacgaagcttcccgaatgctgcaatggtaaacaaggaggaagagttttgag

SEQ ID NO: 1578 - DNA, 88 bp, Arabidopsis thaliana
atttgatccgttgtttacagaattcaagcagagttgtgcataattctttgatgaatatgtatgtttcttgtttgaatgctcctgattg

SEQ ID NO: 1579 - DNA, 185 bp, Arabidopsis thaliana
ctttcttgatctgctacggtgaagtctatggtgcaccggcatctgatgaagctgccagcatgatctaattagctttctttatcctttgttgtgtttcatgacgatggttaagagatcagtctcgattagatcatgttcgcagtttcacccgttgactgtcgcacccttctataaaccctaaattt

SEQ ID NO: 1580 - DNA, 125 bp, Arabidopsis thaliana
gatcattattatcatcgtcatgatcattatcatcgtcatggtcatcgtcatcgtgatctccatcattatcatcgtcttgatcatgatcatcatcgtcgtgatcattatcatttgccttactaatc

SEQ ID NO: 1581 - DNA, 132 bp, Arabidopsis thaliana
gtaataataatattaagaaagcaaccagattggtttcgaaccatcgcctctcaattttgttgtttggagacaaagataatttgtttgttgaatggtaagtgatgaacctgtctgcttacacactattattta

SEQ ID NO: 1582 - DNA, 129 bp, Arabidopsis thaliana
tgtgttggtgattaagtactttcgcttgcagagagaaatcacagtggtcaaaaaagttgtagttttcttaaagtctctttcctctgtgattctctgtgtaagcgaaagagcttgctccctaaacttatc

SEQ ID NO: 1583 - DNA, 82 bp, Arabidopsis thaliana
cctgttgttgctgctgtttctgcaaatgctgcatcagaaagagctgttgttgacgctgttgcatttgttgttgttgctgcat

SEQ ID NO: 1584 - DNA, 76 bp, Arabidopsis thaliana
agttttagtcagcctctttgtagttggagattgggtaagactagaccctctctctttctctctagtataatgacac

SEQ ID NO: 1585 - DNA, 127 bp, Arabidopsis thaliana
tgtgtattcagttgggaagaatgatattgtgtgattggctattatcatcgtaaggctttttgtgtgtgtgaaattccaatcataattgaaacagagcttttgagttttataacacaagagaaaaaca

SEQ ID NO: 1586 - DNA, 104 bp, Arabidopsis thaliana
ttgtaattctgattctggttcagagaatgtttcatgtgtgtgatagttctgtttctgtcttatattatcatcaattgtgtgttttgacttctttgaattaattg

SEQ ID NO: 1587 - DNA, 95 bp, Arabidopsis thaliana
aaggagtagcatgtgatggctctgattgtgatggtggtggtttcacaacattatgatcatcatcatcatcaacgcaaaaaacgatgtcgttctca

SEQ ID NO: 1588 - DNA, 89 bp, Arabidopsis thaliana
tcgttctgtagacaaaatattgagagtgagaatcatgtgtttttaactgcttcaactactagatgttgtcttaacataaagcagaatga

SEQ ID NO: 1589 - DNA, 104 bp, Arabidopsis thaliana
cctgagataaccgtacctagaattgttgattagagagttggtagatattgattccgattgttgttgatggaattgttcataggtatgagaactatttcttcaag

SEQ ID NO: 1590 - DNA, 101 bp, Arabidopsis thaliana
gactgcagatgggaagagactcaagaagtataagcaggtattgaatcgtttattgcttctgtgatgttgttgttgcatttgtggccttcgttgagttttat

SEQ ID NO: 1591 - DNA, 87 bp, Arabidopsis thaliana
cgaacatgacctatactatttgtgtgtgtacgtggagacatatacatttaaagaaaaagacactggtgtggatggttacgttttaac

SEQ ID NO: 1592 - DNA, 105 bp, Arabidopsis thaliana
agcatacttactacagaagctggtttagctcccaagctagaggctctggcatagcttgcaggagcagcagctccagatttagtgaagtaggcaccgttgagcatt

SEQ ID NO: 1593 - DNA, 94 bp, Arabidopsis thaliana
cattgttggatatatcaaagctctctctcctattgtgtataatgaagaaaaatgtaagaggagagagagagaaagagatgtaattaacttggag

SEQ ID NO: 1594 - DNA, 106 bp, Arabidopsis thaliana
tttttttctaatttatgccaaaacggtcttcttctatggttttgtattgaactgatgatttagatttgtttaaatctcggcttttgtatattgtagtggaagattg

SEQ ID NO: 1595 - DNA, 131 bp, Arabidopsis thaliana
gggcattgacattgggagcctctactcagtactcaccttgttgttgtttcacgggttacatatatattaatataagaaggccttttaacaaaaataaataaatataagtctgatttaatgtataaatgtat

SEQ ID NO: 1596 - DNA, 106 bp, Arabidopsis thaliana
gaaacagaagagccctgaggttgttgtacatgtggcatcatagaaccagatgctggaaactgctgttgctgttgctgcaaatacctctggtgaatttgtctttgac

SEQ ID NO: 1597 - DNA, 94 bp, Arabidopsis thaliana
gggtataaaaatgatgtctttgtttgttcatctgtcttgaatctgtatatgaagtgtgggaaaatggatgaagcagaggttttgtttggaaaga

SEQ ID NO: 1598 - DNA, 134 bp, Arabidopsis thaliana
tagaaattcgttttatgatggtgtcacgtaggataggagcatgtggaatatgtggtctgctgtgtatatatatcccaacttatggaatgtgtgaaaggagattatgcttgctttttcgattagtgtctgacatt

SEQ ID NO: 1599 - DNA, 103 bp, Arabidopsis thaliana
aagattttaatatatgtttgtccggatagggtttgttgttgctgcttccattgcagcagttactgttaagcggctcaacgttaaaccctccaaaccaagcaaa

SEQ ID NO: 1600 - DNA, 129 bp, Arabidopsis thaliana
tgacttgagattcttattgcttttcaaaataatgtggatgtctttgcatgagaagattaatcgattggaaaaagattttcgtgtttaagttgattcgactcttgttttgggagaaagtttgctatatat

SEQ ID NO: 1601 - DNA, 93 bp, Arabidopsis thaliana
tatctaagaacatgattgagagtctctctgttcctacattccgtgttggttatcctgtgaacactgacgctcttgatgcactttacgagaagg

SEQ ID NO: 1602 - DNA, 65 bp, Arabidopsis thaliana
aagtaatttaagcagaggctgctggctctgaagttgctgcttctgctgctgcagctctcttcttg

SEQ ID NO: 1603 - DNA, 114 bp, Arabidopsis thaliana
tctgtggactgtgattgtgtgatgtttccatatcttcagcttttcttctactacatgctctaatcacgtccttgtagaggaaaagaaaaaaaatggctgcttcatcttcctctt

SEQ ID NO: 1604 - DNA, 69 bp, Arabidopsis thaliana
atgatgatcatcttcttcctgggtttgttgtcgtggatctcaaacttagagattatgaagagattatga

SEQ ID NO: 1605 - DNA, 91 bp, Arabidopsis thaliana
tctgtatatgtgcaaatgttttgtctgtcttctttgagaagttcactcatgaacaaagatgaagactttaaaaaaaattcttgagcatagc

SEQ ID NO: 1606 - DNA, 118 bp, Arabidopsis thaliana
accttcacgaagtggagtttgtaaacgatgaatcagttgttaaccttttagctggttgtattagcctggaaaatttggtgattcatcaaactacagatcttaatgtgaagacttttac

SEQ ID NO: 1607 - DNA, 63 bp, Arabidopsis thaliana
tgctgctgcagtggatgaaactttgataacttcttttgactcttcttcttctgtagcaggagg

SEQ ID NO: 1608 - DNA, 100 bp, Arabidopsis thaliana
tgtgtcgtgtctgatgtgtgagtgtgtgtctgtgtttgtgagagattcgatactctttgaaacaaagatttatgtagaagaatatagagaaagaaagact

SEQ ID NO: 1609 - DNA, 132 bp, Arabidopsis thaliana
ccttttaaaattccttgtaaaatcattatttaagatagattgatgtttgaggtaagctttttattttggcagccaaggttaacctctaggattattgaggcgtgtgtatctgaaacatctagtattcttgat

SEQ ID NO: 1610 - DNA, 91 bp, Arabidopsis thaliana
gaatggttggatccaaattctgatgttgctgtgactgtattcaaccaaataacagcaacaaatatacttcaagaaagcttggattcaggtt

SEQ ID NO: 1611 - DNA, 94 bp, Arabidopsis thaliana
tcattggttaaagcttactagagcagtgcaaggaagtttatgggctgaagcgcagaaatctgatgaagctgcaacgtatgattaatatctccaa

SEQ ID NO: 1612 - DNA, 106 bp, Arabidopsis thaliana
aattttctcaaggacgctgctagactcgtcttcttcttcatcatctaaccatagagtgagcttcagaagtgttgcattctctaagatgtagttagcaacctcggtt

SEQ ID NO: 1613 - DNA, 135 bp, Arabidopsis thaliana
tctggctgcaaaggaaggtcttacgtggaactggaagctgacctgagtgtcaagtggcatattgttttgtttgttccttggataaaggattgtcttgttcttcatgtgtgttttaagcgttcctcaaggtcttca

SEQ ID NO: 1614 - DNA, 77 bp, Arabidopsis thaliana
gagaaggtggatcgatcgatccctccctgggagatgatttgtgtctcgacgttgagtggtggatcgatcgatcccag

SEQ ID NO: 1615 - DNA, 138 bp, Arabidopsis thaliana
tcggttgtctaaggagggtggaggggtggggggtggggggcttagaaaggagcagagattgctgaaacatgattctctttgcttgcagtggcaatctcagctgaaattctttgttttgtgtcaacttcctgtgtcgaa

SEQ ID NO: 1616 - DNA, 114 bp, Arabidopsis thaliana
ggcttcttttgacgtcaatcagactccaaatgatcttggcgaagaccttatcgattgatcgatcgtgatgttgttgctcttatcaatgttgggtcaaagaagacaagaagtgtt

SEQ ID NO: 1617 - DNA, 136 bp, Arabidopsis thaliana
aatttgagattcagttttctaagaaacttcttcttcttcaacaatggcggcttgatttgatttttgctctctctcatgtgtcaactcgtttcatgtacgtagcatcgagattccagttaattgaatctcttgttat

SEQ ID NO: 1618 - DNA, 87 bp, Arabidopsis thaliana
acaaagtgttagtatgttgtgatgttgctgagttgtgtagctgtgacagttggaaaatggacactcggtcagaatcacaacatatgc

SEQ ID NO: 1619 - DNA, 83 bp, Arabidopsis thaliana
aatgttagtatgttgtgatgttgctgagttgtgtagctgtgacagttggaaaatggacactcggtcagaatcacaacatatgc

SEQ ID NO: 1620 - DNA, 88 bp, Arabidopsis thaliana
acgttgatcgtcacttagctgctgatgttgttgatcatcttgtaacaaggggaatggattggagttataagttgggggacgactggta

SEQ ID NO: 1621 - DNA, 87 bp, Arabidopsis thaliana
agacatcttctcgtcgcaaatcacaggtacatgcttctaataccttaagaaagaattgcttggttgttgatgatgatgggttgttca

SEQ ID NO: 1622 - DNA, 110 bp, Arabidopsis thaliana
gaggattagcaacgttggtgctgcggtaggagaggttggggttgttggttttgaagttgttataccctttgtagccactctggttgttgttgatgtagctgacttcttcc

SEQ ID NO: 1623 - DNA, 89 bp, Arabidopsis thaliana
cctgtcatagtcaacattgtggttgctgttgctagctgcaaggttctcaattagctatgtagcctcaatctcagtcttggtcatgaagt

SEQ ID NO: 1624 - DNA, 81 bp, Arabidopsis thaliana
tcagctatatatctgaatgtgctctttgttggttctcctgacccatgtgtcttctccatgcgaagagctttatgttcttga

SEQ ID NO: 1625 - DNA, 88 bp, Arabidopsis thaliana
tgtctgagtttgttatatgatgtgattgagttatggtttaaccttacatccgtggctgagtttttgttatatgacggctgagtttgtt

SEQ ID NO: 1626 - DNA, 83 bp, Arabidopsis thaliana
gacgcctgagttatactatggctgagttaaacatactgatgagttttattatctcttgtgttgtagctgtgtgtgcgtaaaat

SEQ ID NO: 1627 - DNA, 133 bp, Arabidopsis thaliana
tatgatgttgataaagtacatagattatgagctagtttcatgattccactagttggaatgtgattatgatatgttaattacttgattgtaccaactgatggtttaagaaaagcactttcatggtttggctgag

SEQ ID NO: 1628 - DNA, 126 bp, Arabidopsis thaliana
gaacagagttttgtcggaatttaagtgaggaacttgtgtgtgcttttgcaaatatgcacatgtatgtatgttggagacatttttaatttgtaggatttttggttactttttgaaaaaaaatattat

SEQ ID NO: 1629 - DNA, 79 bp, Arabidopsis thaliana
atgttttctttggtgttttcaggtgtatgacccatagccaaggctcatcacacctagtacactaccacgaggatatcgg

SEQ ID NO: 1630 - DNA, 94 bp, Arabidopsis thaliana
gtcgtgtgtgaagtagataccgaagacatccaatgtttcttctatactcttttggctcaatgttcttctctgtctccgagtcatgacttccttt

SEQ ID NO: 1631 - DNA, 132 bp, Arabidopsis thaliana
tgggaatatgggtttgtcaatggtgtcaagattctaaatttacaattgaatgattatttgtggcttttgcttgtccaattgtgtgtattgagctagtttctttgaatcttactcatccgaaatcaacatgct

SEQ ID NO: 1632 - DNA, 126 bp, Arabidopsis thaliana
atcttaaaaacctattatcagtgttaatgagaatttggtgtttgcaggataaaggctttgtgtgtgttggatgcagcgaaaattggtgtcatgtttacagtgaggtttacaagatgaatcatatat

SEQ ID NO: 1633 - DNA, 108 bp, Arabidopsis thaliana
gaaaagatctggtggtaaagattttgtcttcttctcctaagatctctgttttgagataggcttagagagagagagatagcattctatgtcggaaaaccaaaaaaaaag

SEQ ID NO: 1634 - DNA, 133 bp, Arabidopsis thaliana
ggcgttaaagacaaagcttcaagatatgttcaatgtgagtgtgaatagaatccatctctgtttttggctctgcttttaatgaatcattttggttatgagtaatgaacaaatcattgacattgttgttgttgtt

SEQ ID NO: 1635 - DNA, 113 bp, Arabidopsis thaliana
ttctcgacaaagaaaataaaaactaactgggattacaaagttgttgggttttgagtttaactagttcgggtttggctaatgattacaggtttgttaactccgttatctctgtt

SEQ ID NO: 1636 - DNA, 60 bp, Arabidopsis thaliana
atgcattggtatcaaactcccatatctgccttccaaggtagttgttggtggtgcacaagt

SEQ ID NO: 1637 - DNA, 133 bp, Arabidopsis thaliana
atgttgctctgataccatatagaggctgaatatttcttatatttgatagagtgtgaaactacacatatatatacagaagcgatgaagtaattagggtattagtaaaataattacatttaaaacccttatatat

SEQ ID NO: 1638 - DNA, 100 bp, Arabidopsis thaliana
actattctaaatgctacatagagcacacaagctttgtttgtctggaagtccattttacacggaaggaatctaataaaacaaggggttcgctttgtcattg

SEQ ID NO: 1639 - DNA, 130 bp, Arabidopsis thaliana
tagagagtgatcttgttctggttctgagtgatggtaagaacaatatacatgtgttttcatatacattcacacacataattatgaggtctaagtcacttttctatgagcaggacgaatcgcagagtttgat

SEQ ID NO: 1640 - DNA, 139 bp, Arabidopsis thaliana; identical to SEQ ID NO: 1110

SEQ ID NO: 1641 - DNA, 83 bp, Arabidopsis thaliana
attcacgcaattttgttgaatctcatgaaattatatagaacataattacaagatttcatgtgattttgttgaatagcatgaaa

SEQ ID NO: 1642 - DNA, 73 bp, Arabidopsis thaliana
tggtgccgatagtggaggtgctgctggtgccgatagtggaggtgctgctagtgccgatagtggaggtgctgct

SEQ ID NO: 1643 - DNA, 93 bp, Arabidopsis thaliana
aacaatagatttgcttcctttagttgtgttggctttgagtttctttgctctagcagaagagtctttgcttagatagctctggatccccaagta

SEQ ID NO: 1644 - DNA, 135 bp, Arabidopsis thaliana
cttgaggatgatctaagtggattaggagagataaatttgcatctcaatggagtttgtgtatgatctttctttgcttagattcaaaacctcaacctcacttttttttttcttttttttttgacacagcctcaacct

SEQ ID NO: 1645 - DNA, 69 bp, Arabidopsis thaliana
tatttgctctgataccaaatgatagatttgattttgtcaaagcttgaggaatcagagtaagtacgaaaa

SEQ ID NO: 1646 - DNA, 69 bp, Arabidopsis thaliana; identical to SEQ ID NO: 1645

SEQ ID NO: 1647 - DNA, 104 bp, Arabidopsis thaliana
atttggacgtaaagttaaaaccatccagagttggagctcccttctttagtttcctttaggataatcaataagtgttctgtttccaaatgaatggttttagaatc

SEQ ID NO: 1648 - DNA, 98 bp, Arabidopsis thaliana
agcttcctattgaagagaaagagagtgagattggttcttgtttagatgagaatgatttgatgattggttcaagctttgttgaatcgatggatgaagta

SEQ ID NO: 1649 - DNA, 76 bp, Arabidopsis thaliana
ggaagaagaagcaggaatatccgccaactcgtgaatagctcacttctatttgtctcaggttctttcttcttcttca

SEQ ID NO: 1650 - DNA, 134 bp, Arabidopsis thaliana
atcctctactttcttcttttctaggtgatctggagtgaagtctcggtctcttgtcttcctcttggtgattttcttcttatcacacaaaggcaactcttgactctttaatctttatcacttcaattcaactactc

SEQ ID NO: 1651 - DNA, 137 bp, Arabidopsis thaliana
aagtcatggctttagaagaaatgatagggatacacatagccagaggagacccaacgatagtgatgatgatgacgatgacggtgaattggattctgaggatgatgaaattccaaagagatttgatagagcaagatcat

SEQ ID NO: 1652 - DNA, 115 bp, Arabidopsis thaliana
ttctctcttgcaacccttgaatgtgtttgttgattgatatctacacatgttgatcatccttgtgttgatcgattggtttagatgaccatcaacaaactctttcgtggttttgcat

SEQ ID NO: 1653 - DNA, 103 bp, Arabidopsis thaliana
tgttgtgaagaggactgtgttctgaacttatctttaaaaaacccaatggtttttttgcagatgatggtggtagttcaactccttatcttaatgaagagatttt

SEQ ID NO: 1654 - DNA, 78 bp, Arabidopsis thaliana
attgttgagttaaagatgaacccataaacaaacattaattgcgaacgtacattgatgttgaagatgtgttgatcttgt

SEQ ID NO: 1655 - DNA, 68 bp, Arabidopsis thaliana
gtgatgccaagtatgatgctatgggttgggtgattctagccattggtgttgttgcttggatcagtttc

SEQ ID NO: 1656 - DNA, 80 bp, Arabidopsis thaliana
aagtctaataatgtttggttgtttctctgaggatgagactgggatctacaagaatctgcttcaagagacagcacacagag

SEQ ID NO: 1657 - DNA, 80 bp, Arabidopsis thaliana
gaagatacaatgtggttttgatcattgactgatcttggttctttgcgattcattatcatcatcaatcatggacaacattg

SEQ ID NO: 1658 - DNA, 234 bp, Arabidopsis thaliana
attatttagaaggagaagtcaaagatgaatagaagaatcatatttggtagccaaggatgacttgcctgtttctttgagtaaaatgggttagtgtcatgtttgacaagtgactataagttatatcaagcaatgaccattttactcatcaaaagacatcaggcagtctccttggctatccttatatgttcttctctctcatctcagacgtttaccttcattcaaaataagatggac

SEQ ID NO: 1659 - DNA, 330 bp, Arabidopsis thaliana
ttctgcctttggtttctaaagcattttcatagtttatgtggctgagtctacacattatttagaaggagatgtcaaagatgaataggagaacaatatttggtagccaaggatgacttgcctgcttctctgaacaaaatggtcgatgtcatgttttgaagtgactataagttataccaagaaatgaccattttgtttataaatagacatcaggcagtctccttggctatccttatatgttcttctttctcaactcagatatttaccttcatccaaaataagatagacatgacaacaaatataatggtgagcgaatgttgacgatttttggag

SEQ ID NO: 1660 - DNA, 283 bp, Arabidopsis thaliana
aacacatattgagagtaataaagagtataatgaggaagagaggtctaacatggcgaaaagagtcatgtttagtagccaaggatgacttgcctgatctttttcacctccatgattcaatttgtaattcatgggttttggattattatacattcaaaagtataataatttgaaatcatgttgaatcttgcgggttaggtttcaggcagtctccttggctatcttgacatgcttttttcattcacgttatacctgtttttctttctgtctccatagtcactataaa

SEQ ID NO: 1661 - DNA, 79 bp, Arabidopsis thaliana
gacaaataacatgcaaaaatttatagtaaaaaatttatttgatactgcaagatgtttgcatgttattgttttcgaatca

SEQ ID NO: 1662 - DNA, 123 bp, Arabidopsis thaliana
tgacgatgatgatgaggttttattagcaatggctgaagaattgggtgtgtttattccttatgttggtggtgttgagtatgcacatgttcttcttccacctttggaaactctttcgactgtcga

SEQ ID NO: 1663 - DNA, 81 bp, Arabidopsis thaliana
agggtctgaatcatgcatctctgtactagtattagatggtatgatactaggatctaatgcagatgatgatgatgatgatga

SEQ ID NO: 1664 - DNA, 88 bp, Arabidopsis thaliana
aagtgcttgcccatgtgtgtgtatgtgatctttatgcatatatattatggattttctggattatgaataaacaaatatgtgtaagcat

SEQ ID NO: 1665 - DNA, 100 bp, Arabidopsis thaliana
ttttgaaacagtgcaacagccacatgatgttccttttggttcttactttgaggtatgttacctatgaggaaaatgtggttcttgtttcatgattcttttt

SEQ ID NO: 1666 - DNA, 94 bp, Arabidopsis thaliana
ggtcctaagaggcttcattgagttgtttgattttctcttgagtacaacgacccaagtgatggcttctaagagcaaagcaatgcctccaagaacg

SEQ ID NO: 1667 - DNA, 101 bp, Arabidopsis thaliana
tgatcttatctatattccctgagctattgatgtgttgttcaagctccataaccgcagcttgatatctttcatcagtcaacctctcatgaacaaactgatca

SEQ ID NO: 1668 - DNA, 95 bp, Arabidopsis thaliana
gtcatgattatggtcgtgattgttgtcattgtgatcattgtcatggtcatggttatggtcatggtcatcgtgagcacggtcatgatcgcggtcac

SEQ ID NO: 1669 - DNA, 102 bp, Arabidopsis thaliana
atcatcgtggtcatggtcatcatcatcatcgtggtcatcgtcgtggtcgtggtcgtggtcatggtcatggtcgtggtcgtggtggtcatgttcaggaggcgg

SEQ ID NO: 1670 - DNA, 124 bp, Arabidopsis thaliana
gtagccgtgtctatgtgatgttactatcaactacttcatacacagtttgcatagtaggagtgattttgatgtacatttggtacgcgcctgattcttcatgtcttctcaatatattctttataac

SEQ ID NO: 1671 - DNA, 83 bp, Arabidopsis thaliana
atcaaagtgccaatgtacatgaacttgccatgggcttcttgttgaagctcagaccacaaatttgtgtgatggcttatttggtg

SEQ ID NO: 1672 - DNA, 92 bp, Arabidopsis thaliana
cccatctctaatccttttggacacttcttcttcttcttcttataacatgaagaagaatatgttaatgaaggagaatctcactctatctctct

SEQ ID NO: 1673 - DNA, 80 bp, Arabidopsis thaliana
cagaaacaccggcagaggtctaggtccagatcattggaaaatgacaatggatctcatgagaatgttgatgttgctcaaga

SEQ ID NO: 1674 - DNA, 65 bp, Arabidopsis thaliana
agaaagactctcaccataactcttggctttgttgagaacagaaatggagagagtttttttgatag

SEQ ID NO: 1675 - DNA, 111 bp, Arabidopsis thaliana
gacggtgaattgatggattgatttctccgacacagatgatgatgatgaagcacccatctctcgatcgatctctatcgcacagaagaaactaattaaaattatttgaagtca

SEQ ID NO: 1676 - DNA, 109 bp, Arabidopsis thaliana
gagacatatcgcacacgttccagtgttcccgtcttctttcctttcaccttctgttgaagctggaagagaagcagcagatgggagatcgactggtgttgaatcgattgat

SEQ ID NO: 1677 - DNA, 145 bp, Arabidopsis thaliana
tgggaatgaatgatatatatgttttagggaccggagaaaatattattataataatcggtctgcatgtatatataaatgtgtgtatacagtgtgatgttgaaatatgtggtgtagtgtgtgatatagtttcgagtaaacaaagtcg

SEQ ID NO: 1678 - DNA, 131 bp, Arabidopsis thaliana
aaacgtctgagttacggaggatgtattcccgctattttagaagctttggatagtattgaagatgttgaagatgcgttgagtccgtgggcagagaggcttagtaacaaggagagaacgattatattaaagga

SEQ ID NO: 1679 - DNA, 88 bp, Arabidopsis thaliana
aaggcgaaaccaatgtttgtgcagtttgtgcttgagcctttgtggcaggtttatgaagctgcactagatcctggtggggataaagccg

SEQ ID NO: 1680 - DNA, 118 bp, Arabidopsis thaliana
aaaacccaatcccaaagtagatcatatgtttcctgtacagtagtatgatgtgttgatattgagcatgtttacttaccctccacgggaacgagcagcaagataacttttaaggtgatta

SEQ ID NO: 1681 - DNA, 88 bp, Arabidopsis thaliana
agcgagttaaaatgaagagtttggaggaactcggattctctcatgaaacctccgagtggacttgcccagccttcgcttaatacatgca

SEQ ID NO: 1682 - DNA, 100 bp, Arabidopsis thaliana
cattgatttggcgagtaattctgtatgactagggttatttgtgttttcttaaaaagaatttgtgttcttgttgaaatcttgttcattggaattatttgtg

SEQ ID NO: 1683 - DNA, 90 bp, Arabidopsis thaliana
ccacaacattacttacattatcattggcacaatctggctttgctcaatagtcccagtttctgtgttgcagcaaaaactagctcagatgct

SEQ ID NO: 1684 - DNA, 122 bp, Arabidopsis thaliana
gaacgtgctagcaaagctgagattgagactaagatacttgcagaagcacttgcaaagcttgaagctgagagggatgcagcgcttcttcggtataatgaatccatgcagaaaataacggagct

SEQ ID NO: 1685 - DNA, 91 bp, Arabidopsis thaliana
agttttctgttctatgcaaagccaagagggtgtcaatgcggatggtgtgacaatgatgagtattgcatctgcttgtgggcacttgggagct

SEQ ID NO: 1686 - DNA, 73 bp, Arabidopsis thaliana
gtcagagaaggcagccgaagcgtaggattcacaatgctgaaacgtctagtgctgctgctgctgcttctcagtc

SEQ ID NO: 1687 - DNA, 111 bp, Arabidopsis thaliana
cttcatctagtagttacctcgattttgtttctcactacttttctttgggtttgtgtcactgaagagagacaggatatagagcaataatggaaggggtctatttataagagg

SEQ ID NO: 1688 - DNA, 135 bp, Arabidopsis thaliana
tgaatcagacaacttagcagatacagttagctttgctgatacttttaggtttgtatctttagatcatgatgtgcataagtatcagttatgtatccaatgtttgaattataagttagttttgtttctaaattagta

SEQ ID NO: 1689 - DNA, 90 bp, Arabidopsis thaliana
ttttgttagtatgtaagtttggtttgttgtagatttctgtctagagtacggatctctactgatcacagccattttgatgtgatttacaaa

SEQ ID NO: 1690 - DNA, 74 bp, Arabidopsis thaliana
gtgatggtgtatatatgtatgtatgcaggactgtttatggagaagtgtctgcaaaagtagatgtatatgcattt

SEQ ID NO: 1691 - DNA, 102 bp, Arabidopsis thaliana
tcaaatataataactcttctatgtgtatgtggttgtgaatgtagatttggtgtcatactgtcatgtctacataaatctcaagtatattttgacgagttattt

SEQ ID NO: 1692 - DNA, 85 bp, Arabidopsis thaliana
gattatataactacatattatgcattaaaacttgttagtgatttgctaattgttatctcttgtgtatgtgtatgtgtatgatgta

SEQ ID NO: 1693 - DNA, 112 bp, Arabidopsis thaliana
tgataacgtaagataatggtttgcaggaccgtacacttatacaggctggttctgaagttatgttttgattttggcatgtatatgcgtaaggttctttctatttttctctact

SEQ ID NO: 1694 - DNA, 97 bp, Arabidopsis thaliana
tcacgcgtgaagatcgaattgtgagtcctctccggcgatcgagaaagttttgattcccgatcgcgcaaaagtatctcatatctcgatgatttcatca

SEQ ID NO: 1695 - DNA, 125 bp, Arabidopsis thaliana
aagtacaacagtttcgaccaccttctgtgtcttcattttgattattcattttttttttgttttcaagaatttggtatttttgtcggaaagatgaagaagatgatgttataagattttggtttgct

SEQ ID NO: 1696 - DNA, 129 bp, Arabidopsis thaliana
tctctgtgattaatctttgcttgctgtgcagttaacatctactttcttctgttcttgacatgttttgttcttttggttgcagccgagagtacgtactgttgcacgagaattctgccgagtgaatgaaat

SEQ ID NO: 1697 - DNA, 106 bp, Arabidopsis thaliana
agatagttgcgtttctcagggtttttagagatgtttgagctgcttcatgtatgctttctaccgtgctggtgataatctcagacatcatttagaaatcttttgcttg

SEQ ID NO: 1698 - DNA, 68 bp, Arabidopsis thaliana
ggaggcagtggtcttggtggaggaggcggctttggtggaggaggcggtcttggcggaggagctggagg

SEQ ID NO: 1699 - DNA, 70 bp, Arabidopsis thaliana
gtaagaactttggactacagagagagagaggtttgtcactgtcttacctcggaagtccaattagttttaa

SEQ ID NO: 1700 - DNA, 73 bp, Arabidopsis thaliana
aatccatgatcatgatcatgatggtgatagaaaagtcttattcttctatcactttcattgtttttggccaaag

SEQ ID NO: 1701 - DNA, 117 bp, Arabidopsis thaliana
aggcaaagtctcggtttttgtattgtgtgtgtcacgtgctggtttttattttatttttcacttattaccacgcgcgtttgagagagagagagagagacttaaccacaccaacgaacc

SEQ ID NO: 1702 - DNA, 78 bp, Arabidopsis thaliana
aaactgatgatgctggtgcattggctgcagtgggatgtctccgtgccatcagtaccattcttgaatctatcagtagtc

SEQ ID NO: 1703 - DNA, 127 bp, Arabidopsis thaliana
gatattgtcctttgtattttcgttcctagttcctccaatcgtgtttcatgttatgttggcttgtgtttcagatgttggtggatgatattggtgatgtgactattacaaatgatggtgctactattct

SEQ ID NO: 1704 - DNA, 133 bp, Arabidopsis thaliana
gaagttagcattgcttcctttctgtgttgaggctttttcttttcttgttgtagctccaatgcatggttttgcattttggttcgacgttgaattcagcggaccggcctcttcacctgccaagaatactagtgaa

SEQ ID NO: 1705 - DNA, 90 bp, Arabidopsis thaliana
aagtttcatggtgattcttgtctgtgtttgactgtttgttagaccgtttcttttacagacataatttaccttatttatctttccaatttc

SEQ ID NO: 1706 - DNA, 73 bp, Arabidopsis thaliana
tgttgcgaagtgcaatcatggagagagttttcaagaggggaagattcttccttttgctgatttgcaacttaac

SEQ ID NO: 1707 - DNA, 75 bp, Arabidopsis thaliana
agagcaggtaggcctggagagatctgtggtattgggtttatgaaatttggtattgttggttcttgggcctgcgga

SEQ ID NO: 1708 - DNA, 140 bp, Arabidopsis thaliana
taatcctcactgagatttgtgcttgaatcttgattatcttggtgagagtttttgttttagacaatgtatatatgtgtttgagaatacaagcttcttctttattttaatccaacattaatcagattgtatgaatttgaata

SEQ ID NO: 1709 - DNA, 145 bp, Arabidopsis thaliana
ttcgaaaaatccaaatttttagtcgaatcgcagtgtagtatgtatacattacgtatagtatataaatctatgtgtgtgtatatcagtgtatgtatttgtgtatgtatgtacatgtgaaaagaatctctactaaagatttccataa

SEQ ID NO: 1710 - DNA, 85 bp, Arabidopsis thaliana
taaaacctttttcgacttcatgaaagcaaagaaaggtatcttgttatgtactgatgttgctgctcgtggtctcgatattccttcc

SEQ ID NO: 1711 - DNA, 84 bp, Arabidopsis thaliana
atgacgaagaagaagaagaagaggatggaggaggagactctgtagaagactccgtctccataacttttacgatcatcttctgac

SEQ ID NO: 1712 - DNA, 131 bp, Arabidopsis thaliana
tttcagtttcgttcccccatgtggattcttgatatagttgtatatcactgcttctatgtctgattttgttgtaataaccacttcggtttttactggtctctcttgaacttttacattgatgtacggattga

SEQ ID NO: 1713 - DNA, 80 bp, Arabidopsis thaliana
tggtccaaggaaacaagacaagtgagattttgaaaccgcaggctgaaacttgtattgttgccttgtttccaaatgcataa

SEQ ID NO: 1714 - DNA, 77 bp, Arabidopsis thaliana
catcttcttcgtcatcgtcatcatcgtcatcagcttcgtataggctgttccgattcatcgcgatacagaaagagaaa

SEQ ID NO: 1715 - DNA, 95 bp, Arabidopsis thaliana
ttatgagagaaatacgtattggcagcttgctgtgctggtacttgtgataaacttgttccgtgttctgcttgttatgagtatgttagcttgtatga

SEQ ID NO: 1716 - DNA, 137 bp, Arabidopsis thaliana
tttaaagaagagaagagaagagaagagagagcgtgagagagagtaataatgaagtacacagcatgtgtgtgtgtgatagacagtgagtgaatgttaacgttatggattcttgttcgaaaatgtgttagtttatttat

SEQ ID NO: 1717 - DNA, 77 bp, Arabidopsis thaliana
tttgagtcttcacaagaagaaggagattcaggaacgacgtcgttgtaagtctcatcttcttcgtcatccgattcttg

SEQ ID NO: 1718 - DNA, 94 bp, Arabidopsis thaliana
aaagagagcttgaccgacgatgatgctgagctctgagaagttgggagaaactcatcgatgacttgaacagtgttaagatgttgatcttgctttt

SEQ ID NO: 1719 - DNA, 123 bp, Arabidopsis thaliana
aacattcatcttttctctagattgtagaatactctgaaagcagaggttgatcttgattcttgaaatttgaaatgtgtttttaggtgcatatggtggagtggttaaagctaatggttcaacaga

SEQ ID NO: 1720 - DNA, 75 bp, Arabidopsis thaliana
gagatcaatgaagaagatgaagatgtcactccagttactgctcgaggacctgaggtctttggtgcttttttgaca

SEQ ID NO: 1721 - DNA, 72 bp, Arabidopsis thaliana
aatatagctaagaagatgccgatatttgagccggagagatcggaatcgtcgtcgtcatcttcagccgctgct

SEQ ID NO: 1722 - DNA, 104 bp, Arabidopsis thaliana
cacggtgttcgaatctgaaacattggctgattggtttgtgtccatctgcactaagatagaggtttaccataccaggcgagtgtggaggtatgatgcaacggtag

SEQ ID NO: 1723 - DNA, 122 bp, Arabidopsis thaliana
ggcgacggcgtcgtttatgtcttcttcttcttcaatatcaagttatcgagatgtttagttgaagctgaagcagctgggttcagagaagagaagaaatcttatccgagagttagttagttatt

SEQ ID NO: 1724 - DNA, 71 bp, Arabidopsis thaliana
tagtactatagtagtggctgtgctgtgtgttgacaaatcaatggagcagaaccattaactcctctagtaca

SEQ ID NO: 1725 - DNA, 121 bp, Arabidopsis thaliana
cgtttaagaaacttaggagcattgttcaagctgttcaacattacaatgatcctcatgtgttggctgagatgagttctggattggagaatgcaatggagagcttaaatgttcgtggtgacag

SEQ ID NO: 1726 - DNA, 82 bp, Arabidopsis thaliana
tgaaaggtcatcagaagagagtgactggtttagcattctcaaacgtgctaaatgttcttgtttcctctggtgctgattctca

SEQ ID NO: 1727 - DNA, 81 bp, Arabidopsis thaliana
acagtggagagactctgtagagttctgatgatgatgagatcaaaaactgtctctcttagatcactacattctctcaaattc

SEQ ID NO: 1728 - DNA, 94 bp, Arabidopsis thaliana
ggaagaggaactgtggaaatcaccattgagaaagctgatggttcgactttttcagctgaagctggaggtgatcaaagaaagagtgctacagtac

SEQ ID NO: 1729 - DNA, 123 bp, Arabidopsis thaliana
gattggaaagattcagcgaaccagatgttcgagctgctttcagaatccgatccattaaatatttctctctctctcgatctctcgcgttcgttcgttcttctccgtcgttattacagtgccacc

SEQ ID NO: 1730 - DNA, 101 bp, Arabidopsis thaliana
acgaacaaacaaatgactacaattactactagaagaagatgatgatgatgactcgttcatcatcactggatcgatcatcttagttctctagtttaaaaaaa

SEQ ID NO: 1731 - DNA, 134 bp, Arabidopsis thaliana
gtactatccttaacttattctcagcattgcgattggtcttttggcaagttcttgataattttattcttcttcttgaatgatctcttaggtaacattgctactggatctatagaatctggtaatgtttgcttccc

SEQ ID NO: 1732 - DNA, 97 bp, Arabidopsis thaliana
gatgtaacacttgttgatctgattgatgctggctttgagttggattggctgtagacaaagctggatgaggtctctcggaagaagaagatggagcagg

SEQ ID NO: 1733 - DNA, 133 bp, Arabidopsis thaliana
aaaatgcagggaaggattcataggcatgagtcgaggagatggagactgagtgactgactaagggtatgtgactgaaaatgatgaagaacccctactctgttttcgattgatgaaagtgaaattaatttctccg

SEQ ID NO: 1734 - DNA, 84 bp, Arabidopsis thaliana
aaagaggtagatgtagtcatcaatgttattgtgtggaggtttcctgatgatgatgatgatgatgtagatgtgagacttgcggtg

SEQ ID NO: 1735 - DNA, 81 bp, Arabidopsis thaliana
gaacttggttttgatgctgatggtgtgatgctctaggataatcacagaactctcacgccattgtaattgtgtaaaaaaact

SEQ ID NO: 1736 - DNA, 96 bp, Arabidopsis thaliana
atcctcctccttacggaccacaggctgcgtgggctggtggctacgatccgcaacagcaacagcagcagcagccgccaccacaaggacaaggacatc

SEQ ID NO: 1737 - DNA, 80 bp, Arabidopsis thaliana
ccttcaatgaagtatcttacttcatatcggtatctttaactattgaaggtgttgattggagtgaagttccttcgtcgatg

SEQ ID NO: 1738 - DNA, 70 bp, Arabidopsis thaliana
cgtggtagtgagttgcatcattaaatgttataatactcatgatgatgatcatgatcatgacaacaacaac

SEQ ID NO: 1739 - DNA, 83 bp, Arabidopsis thaliana
aactatggcaacagcagctggagcagctgctcttttatattacacgttgaatcggaaattaatagctggtccatctgacgttg

SEQ ID NO: 1740 - DNA, 83 bp, Arabidopsis thaliana
acgcttaattcttgttgcacccaacattcattgcaattacgagtaaatttctatgtgattgttgattgattatgttacgagat

SEQ ID NO: 1741 - DNA, 99 bp, Arabidopsis thaliana
aacaaataaattatatataacgatacccctcacaaatcaagtcatgttttcttttgttgctatcagcgacagtaaaataaaatctgatttcttgagaaa

SEQ ID NO: 1742 - DNA, 63 bp, Arabidopsis thaliana
gaagagactcaggcccagtgttcctgttgcttcttctgcagcacttgatgctcctgtctctct

SEQ ID NO: 1743 - DNA, 95 bp, Arabidopsis thaliana
tcctcttgttcttgcatctggatatgcggttcttgatgatgatgttgatgagcacggtcacggaacatagccaattgctgaagaacaatctccaa

SEQ ID NO: 1744 - DNA, 133 bp, Arabidopsis thaliana
ttgggaaataagaatggaagatggagatacctttgctggattaatgtggaaaggagaggcagtttccttttgttcattgtggaagtagctctttatgtttgtctttagtttttgttgtaagcttccaaattta

SEQ ID NO: 1745 - DNA, 103 bp, Arabidopsis thaliana
aatcacgaatcttgtatgatcactaaccattggaacaataagagtatataatgagtatatcaccatttagttctagtgggtggtgatcatataagattggtaa

SEQ ID NO: 1746 - DNA, 80 bp, Arabidopsis thaliana
atcatagggagagagagtcatgaacgtgaatggacttagaggcccatgtctcgagcatcctggcttccttttccaatctc

SEQ ID NO: 1747 - DNA, 77 bp, Arabidopsis thaliana
agaagtcatctttatactgaaacttgcaaggtttgcaggcaagtgcttgctttttcatgtttataacgatggcttct

SEQ ID NO: 1748 - DNA, 132 bp, Arabidopsis thaliana
ccaactttaaaatgcacaatatgacatatcccatttattactatacaacgaatacgtgtggatttatgtgtgttaatctagctggtatgtcgtaatttaaatttgaagtctccattgtatataaatcgttta

SEQ ID NO: 1749 - DNA, 75 bp, Arabidopsis thaliana
aacacttgtcctttaaacgtttgcaggcagtttggagtatgatgaatggtcaaatcacaggcaggcttggaaact

SEQ ID NO: 1750 - DNA, 133 bp, Arabidopsis thaliana
ttgtaaggactgcgctggtacataacttaaagataagattggacgatggagtaaatatgttgtttgttttctctcacacttcatcagttttcagatctttgttattattcgttgttgctcaccttttatttct

SEQ ID NO: 1751 - DNA, 135 bp, Arabidopsis thaliana
tacttactatatctgctttgcttcctgcatgtgattaagtttgtgtagatcggtccatagtgattttggtttatgaatcggttattcaattttggttatatcgaaacagagccggtttagtgtgtcaagcagata

SEQ ID NO: 1752 - DNA, 142 bp, Arabidopsis thaliana
ggccctcttcctttcgagctcgagaccgggtaggttcctcttcttattatcctgataatgtatgactatatatatgtgtgttctgagttttggtgttgaatgagtaaggtacattggtgtgggtgaggcagagaaagatcaa

SEQ ID NO: 1753 - DNA, 73 bp, Arabidopsis thaliana
tcacatttatcctgctttgttcaggttgttgtatgtatgaaattacagcacaccagcctgcgtttaaagctcc

SEQ ID NO: 1754 - DNA, 131 bp, Arabidopsis thaliana
aagagaataactgttacctacaaaaaaacacttgtaagttttcttatgatagtgaatctgattttgttaaattgtttacatattccttgatatgtctagttttgttggtttatggaggcttataattgttc

SEQ ID NO: 1755 - DNA, 103 bp, Arabidopsis thaliana
ttcttctccgattcgctgtgagtttgacttgattttgattcttaattgattccgtcgtcgagaattagctcgtgttaggtttcttcttttgtactgtttcgtg

SEQ ID NO: 1756 - DNA, 102 bp, Arabidopsis thaliana
atgacaaaactgacattgggatggtggtacgtttctctccatctctctaactcacccacagaatcttcttgtcatttgttttgtttaaacattctacttttt

SEQ ID NO: 1757 - DNA, 101 bp, Arabidopsis thaliana
ttccaattcccttaaatacatctcacagtcttcttcttcttctcgattgcagtagctgaaatgaatggagataatagaccagtggaagatgctcattacac

SEQ ID NO: 1758 - DNA, 176 bp, Arabidopsis thaliana
tacatccctatcatcaaccagctactgttcgctgttggagcatcatcaagattcacaaatcatcaagtattcgtgtaaataaacccatttatgattagatttttgatgtatgtatgagaatcttgatgatgctgcagctgcaatcagtggcttacacatagaaacaggtttgtgtt

SEQ ID NO: 1759 - DNA, 83 bp, Arabidopsis thaliana
ttttcaatgctctgtttcttgttccttgcaggagattcttgttaggccttctcaagtacggtaaaggagattggagaaacata

SEQ ID NO: 1760 - DNA, 108 bp, Arabidopsis thaliana
tgaaaccccatagttgttttccatcctggctcttctcatgtgaagtaaaaattgaaactttgtgatgatgatggagttcgtttggaatgagattgtctttgaatttgc

SEQ ID NO: 1761 - DNA, 115 bp, Arabidopsis thaliana
gcaaagaaaggaagacagtgatgctgatcaattgatgatgatgatgatgatgatctctcagagagactctggttctcatgttttaatcaatatgttaatcaactttttttctttt

SEQ ID NO: 1762 - DNA, 110 bp, Arabidopsis thaliana
agaagaagagtaacacgtcatctctgtgcttctttgtctacaattttggaaaaagtgatgacgccattgctctttcccaaatgtagacaaagcaataccgtgatgatgtc

SEQ ID NO: 1763 - DNA, 109 bp, Arabidopsis thaliana
gtctcagtctgaccaatgggttcacaggtgagtctctgtctctctgttttgaagagattgtaaggaaactagggcttgttttcttgtttagactgttcatgcaattagt

SEQ ID NO: 1764 - DNA, 86 bp, Arabidopsis thaliana
ttcttccaagatcttcttgttggtgtggaagtctagtgtcatccgtgagtagtacttctcaatcacctgacgtgaagacttcttaa

SEQ ID NO: 1765 - DNA, 67 bp, Arabidopsis thaliana
tagagaaggaggacgctcatcttcttctgcgtgctcgcgtttgagtgtgtcctcatcttcttcataa

SEQ ID NO: 1766 - DNA, 94 bp, Arabidopsis thaliana
aaacctcctgctgctagatctatacgcattgttgttgttgttaccggaatcttggtaactcatcataagctgtcttgtttgttgttgggggtgc

SEQ ID NO: 1767 - DNA, 134 bp, Arabidopsis thaliana
tatctaatcgtgagcttcttttttgcaggagaaagctgtagatggtcttaccatgcctcctctttttcagtttctcacagtattggcatttaagatttttgtttgtgaaaaggtatattactattctcatcaag

SEQ ID NO: 1768 - DNA, 145 bp, Arabidopsis thaliana
ttgtccaaggtattatttattgctttagttatgacattgttgtgtggctttataccttagatctttctttctttcttttttgtatccaaagcaacatggtcttaaatcaagcttatcactgcaggcaatagaactttctcacctt

SEQ ID NO: 1769 - DNA, 105 bp, Arabidopsis thaliana
cgtgatcagttttgttatgttggctccatgagactgagagatcctgattcaggtcctcttcatgctcatcatctgtagaaacatcaagaaatgttttacgctgtg

SEQ ID NO: 1770 - DNA, 77 bp, Arabidopsis thaliana
tgcgccgccgccggtgcaccgtcacgtaacccgagcggatatgcagtttccggtggaagaaccggcgccaccaccac

SEQ ID NO: 1771 - DNA, 112 bp, Arabidopsis thaliana
ttttatttccttcagaagaaatactactgatagaagaaaaacgtcatcgtttttgttgccttcgtcgtcgtcgtcttcttcttcgtcagctatttatatgaagaggtcaaag

SEQ ID NO: 1772 - DNA, 123 bp, Arabidopsis thaliana
ctctggagcaagttcctctcttctctctccttatcttacagagatcatcacacatctccttgcagctgctgagcgtacagatggggcagagtctaagctaagaggtgctgcgtatgaaacctt

SEQ ID NO: 1773 - DNA, 67 bp, Arabidopsis thaliana
gaagtggtagaaatggcggcgccgcggcggagtaggaaaacgatgtccggagagctgtcctgatcgc

SEQ ID NO: 1774 - DNA, 86 bp, Arabidopsis thaliana
gtggatgaactggtgtatcagatattcattacattttaattagctagctctcattgtgttgtttgatattcttcttcatctgtctt

SEQ ID NO: 1775 - DNA, 128 bp, Arabidopsis thaliana
tgaagcctctttggagctcaaggaacttggtttcatgacagtaccaaactacttggtgcaggtagtatattgtattattgtctatgcaggcatgtctctttattgcattcaattccctcttcattgta

SEQ ID NO: 1776 - DNA, 139 bp, Arabidopsis thaliana
tggtgtcgatctcccttacaagttcagcccttccactgactgcgacaggtaaagagtacatctcactctctctctttgtgattactgatcttgtagaaaaatctaaaccactaattcctttttctttttctttttttta

SEQ ID NO: 1777 - DNA, 61 bp, Arabidopsis thaliana
ggtgacgtcatggtcatcgtcatcgaggttatgatgatcatcttgatggtgatgatcgtag

SEQ ID NO: 1778 - DNA, 85 bp, Arabidopsis thaliana
ataatggagtcattcttgagtgttgatgtctttgtaattaaatcatttccgagagacgtcaagtgcttttctatgaaatatttaa

SEQ ID NO: 1779 - DNA, 101 bp, Arabidopsis thaliana
cccctggatcttgaaattgtgtctctgagcaagtaatttgtgtgatttaaggagcaattttagcttttcattgattctttgttttaggattgttctagatc

SEQ ID NO: 1780 - DNA, 96 bp, Arabidopsis thaliana
tttcttatcacctcttcgaagatgatccaagaagacgttgtactccttatcaaccataagatcatcatcatcatcatcttcgtcaagacagataat

SEQ ID NO: 1781 - DNA, 78 bp, Arabidopsis thaliana
gaatagcaacttatggtttgcctcttatgctgctgcggcgaagtagaagaagacgaagaattgttgttgttgctgttg

SEQ ID NO: 1782 - DNA, 85 bp, Arabidopsis thaliana
tcttgcttcagagagacctagaagagttatcaacatgagtcttcttctacatctctttgctctgtctctgctcatctctgtttca

SEQ ID NO: 1783 - DNA, 97 bp, Arabidopsis thaliana
ctttgataaaggttctacattctttgataatcatgttcttttctggtgtttctaagattgattttgttggagaatgactagagaactttggtaacac

SEQ ID NO: 1784 - DNA, 126 bp, Arabidopsis thaliana
ttgctactactactaccccaaatcagacagagcataatcaagataacaagagctttgaattgaagagttctgagttgttgttgattaagctctttcagtttcttgttcctcttttcatcttaggtt

SEQ ID NO: 1785 - DNA, 98 bp, Arabidopsis thaliana
cttttcgtaaagattaaggatttaatctgtgtttgcaattggagatttgtgaacattttgaattgaatttgttgattcttttactaagtttctgttcc

SEQ ID NO: 1786 - DNA, 93 bp, Arabidopsis thaliana
cacagtaagacttctaattcaatttggtcagtatatagagttgtgttatatgcatttgtctgatgttgttgaagcttgcacaagtgtaggtca

SEQ ID NO: 1787 - DNA, 69 bp, Arabidopsis thaliana
aaaggagcaggagaggctggataaggagaagaatcctgagcatccttctctctctgccagttaaacaaa

SEQ ID NO: 1788 - DNA, 138 bp, Arabidopsis thaliana
cgctggaattttcaggcgtgatataatcattgttgctcattacaccaaactgttgtcccatgttgttgttgttgtagtcgtaattcatgaattgattgttagaggttgtgatgcaagatgacgtgccggctgatcctg

SEQ ID NO: 1789 - DNA, 132 bp, Arabidopsis thaliana
gctttgggtgttaatcagctcaagaaaggaatgaattctggaaatcttgatgagattcatcagtttcttgatcgtttctacttgtcgcgaatcgggatccggatgcttattggtaagacttgtttctatttt

SEQ ID NO: 1790 - DNA, 141 bp, Arabidopsis thaliana
tgttgtgcagctccaaaggaactctactggcaaataatgtcaaagtactgagacatagcttaagtgtgtgtgtgtgtacttccatgaaaagtcgtcgattcaataaagctttagattgccatttgtatgttccgagaatgt

SEQ ID NO: 1791 - DNA, 78 bp, Arabidopsis thaliana
tggtctatggagaagataagtcagaggttctttaagttttgttgctttcagctttgatgatgtcgttttctatggtct

SEQ ID NO: 1792 - DNA, 78 bp, Arabidopsis thaliana
tcttagttggagatgggagatataagtgttttttactcatgtatgtgttctcttgttgttcttatgaatcttccactg

SEQ ID NO: 1793 - DNA, 117 bp, Arabidopsis thaliana
tcatcaacctttgtgtgttaattgtagagttactgaaataggttttgttcttgttggttgtgacaggaaaaacttgggcagctatgagaagagagagacttgtcagcaaatacatcc

SEQ ID NO: 1794 - DNA, 138 bp, Arabidopsis thaliana
agaagtggcaagttgttcacttttaatttggttctaatcatggctattagattcctaattatgtgtgtatatctaaatcaattatgtcttgttgtttttagggattgaatgtgaagttggaacatatcttgagggcga

SEQ ID NO: 1795 - DNA, 85 bp, Arabidopsis thaliana
agagaagcaaagctcgctgctttagatgtatgtgttgaactttgttcacggtgacagatggagaaactgtaagtgtgctgcttca

SEQ ID NO: 1796 - DNA, 81 bp, Arabidopsis thaliana
gtagaagttggggacgggtttagccttgaacttgagattctttctaagttgcttcaaggctgcttcttgttcatcctgcaa

SEQ ID NO: 1797 - DNA, 65 bp, Arabidopsis thaliana
ttcctaagtctagctcatgatcatcatgaggatttcctaaatcaatttcatgatgatcatgatca

SEQ ID NO: 1798 - DNA, 115 bp, Arabidopsis thaliana
attggtaggatttgttcactaagacatgaactagaaaagcaaatagagaaaaatattgctctgtttctgattgtatcttagaacaaaaagttaccacctttatccaaaattttta

SEQ ID NO: 1799 - DNA, 110 bp, Arabidopsis thaliana
atatgtggtttatgttttgattgtgtgcaagtatacatttgtgtatgcttgtatacattgatcatcaagcaaatttaaatcataatcacttcttctcacgttttaaattt

SEQ ID NO: 1800 - DNA, 100 bp, Arabidopsis thaliana
atttgagtttgattcctcatgatgtctctgtctgtcaatctgtagggcggctgagcttggttttatgacagctaaagctgatgaggaacggaatagacgt

SEQ ID NO: 1801 - DNA, 83 bp, Arabidopsis thaliana
agacggaacttgtgtgtgtgtttcaccagaaaaagaaaaaaatagtatttttgggagcatcgacaatatgcagattccatccc

SEQ ID NO: 1802 - DNA, 84 bp, Arabidopsis thaliana
atcaagatcaagatccttgaagctgttcttggggagtactaattcccaatcctcgagatccatcttctccttgatcgatcttgt

SEQ ID NO: 1803 - DNA, 76 bp, Arabidopsis thaliana
aagaacatcaatgtcaaggtcctcttggatgtcaacaactttcttgatctcttccttgatggccttgacgtaatcc

SEQ ID NO: 1804 - DNA, 76 bp, Arabidopsis thaliana
gctagagagcacacaggacctgctcttgctgtatcattcttcattgctggagtagctgctgctctctctgcctgtt

SEQ ID NO: 1805 - DNA, 97 bp, Arabidopsis thaliana
agaaaaagactagaatcagaggtttaagtttcatcatgatcatgattattatgattaatgggaaatgtcttttgatttcaagatttgcaaaaaataa

SEQ ID NO: 1806 - DNA, 133 bp, Arabidopsis thaliana
tcttcatcatcatctgagtcaccacccattctcaaagatcggttttcttctggcacacggcttttcttcttcttgcgagagaagcagcaactgcagaatccgggatggtgttctttagcccgaggtggatcga

SEQ ID NO: 1807 - DNA, 79 bp, Arabidopsis thaliana
tatctctagtgttgatgatgtttgtatgtggaagtcatgttctatttgcttccacggtttaaaaaccatcaacttgcta

SEQ ID NO: 1808 - DNA, 81 bp, Arabidopsis thaliana
gcagatactgatggtatccttgtttctcagattgaattatccgtttaaaaggacacaagtgatgttgttgatttgttaaaa

SEQ ID NO: 1809 - DNA, 126 bp, Arabidopsis thaliana
cttaggtgtgttgtaatgtcgctgaagttgggattgttatctccaagtagttagcttctctgggtctgtttcgatgcaatggtgggagattccttcataacttggtgtagaattataggattccct

SEQ ID NO: 1810 - DNA, 133 bp, Arabidopsis thaliana
gagtaaacctgcttcagctgcagcatctagtgcatctgctggcacatcgcaggtgagttggttctgttgttatgacatcattataaaggctcagatgctgcaacttgggatttttggaaaaacttcttgcctc

SEQ ID NO: 1811 - DNA, 91 bp, Arabidopsis thaliana
atgctataattgctggtgctgctgctgctcctgaggagataaaggctgacgctgagaatggagaagcaggggaagcgcgtaagcgtaagca

SEQ ID NO: 1812 - DNA, 85 bp, Arabidopsis thaliana
gcctgatcatgcccatgatgatgctagtggacctgaatcagatgaggatgacaatgttggtgatgatgagcatgatttgcgcgaa

SEQ ID NO: 1813 - DNA, 95 bp, Arabidopsis thaliana
gtctctgtagtgtatcttctgctttctctacttcttgttctatgattggccgataatcaaggaagagaaacagatggaatatggatatgcaccga

SEQ ID NO: 1814 - DNA, 82 bp, Arabidopsis thaliana
tttcttggagtatttgtaatatgtgtgtgtacatgcatgtggtgtatgtatatatggacactcacgattgatttaatgctct

SEQ ID NO: 1815 - DNA, 82 bp, Arabidopsis thaliana
ggaagagagcattacattatcaaatagtatactatttgtataaagtcgttactatttgtgatgactgatgagttagtataca

SEQ ID NO: 1816 - DNA, 83 bp, Arabidopsis thaliana
aagtatggaggtggtgatgaagaagatgacgaagaacttgatttctgtgatggatttttatcttcaagatcattactatttct

SEQ ID NO: 1817 - DNA, 108 bp, Arabidopsis thaliana
gtggaattttttgatatgagaatgaaatcatctgctgctagaattaacgcggtcacacatggtggtgatgctgctgcggtaattttttctaacttgtgttccaaataa

SEQ ID NO: 1818 - DNA, 102 bp, Arabidopsis thaliana
atgcatcagattgaaaccattgccaaccctaagggtttgtgtgctgtttctcagggtgttggttctatggttttggtatgtccaggtttgcagaaaggtcaa

SEQ ID NO: 1819 - DNA, 137 bp, Arabidopsis thaliana
tatgcatcaatggggttttgtattacttatctagaacttgtttcgaggaaacactgtctttgattgtttgctttgatgttagctctgaggagttcaagtttattgagtcagaatgcttagatgatcatatagaggac

SEQ ID NO: 1820 - DNA, 93 bp, Arabidopsis thaliana
gtacgcgctgcgcatatttctcaacacattactatcatgcacacatatctgtatgtatgaaagtatctaaccatatatgttctgttcgatgca

SEQ ID NO: 1821 - DNA, 78 bp, Arabidopsis thaliana
tacagcaattatattcgaatgtgagctcgacactgtatctcattgttgtagttgtttcatatgattgttgtcctgttc

SEQ ID NO: 1822 - DNA, 132 bp, Arabidopsis thaliana
agagataaaaaagataggaacgatctttacaaaaaaaaaattctaagaatgtcaatgatttgtttgtttttcttacagccactgtcaaatgagtttttaaatgtcattttgtaaagcagtcaattttaaaaa

SEQ ID NO: 1823 - DNA, 87 bp, Arabidopsis thaliana
aaagacatcatcctcattgcgtctggagcactcctcatagttatgcttatccttgtttgtgttctatgttgcttgctgaggaagaaa

SEQ ID NO: 1824 - DNA, 96 bp, Arabidopsis thaliana
gacattgtgaattaggtttttaagagcgacgcatatggaggaagatgaaagacggaaactctgtttctgtgtggtagtgaagaagctaaacacaga

SEQ ID NO: 1825 - DNA, 87 bp, Arabidopsis thaliana
gtccattgccttctttgttgttggagttggctacgttggaatgccggttccaagtacgccggtccagacttccgagtaaccactgac

SEQ ID NO: 1826 - DNA, 94 bp, Arabidopsis thaliana
tggggcttttcttcctacgtctggctctcctgctgcagccgctggtttaaccatttacttagctggagctcaaggtcaagttgtgggaggtgga

SEQ ID NO: 1827 - DNA, 74 bp, Arabidopsis thaliana
gtagctctcacaatgttgcagaatcttttgctggcgattttgagtccgcggatggagaagctggagtattggtg

SEQ ID NO: 1828 - DNA, 121 bp, Arabidopsis thaliana
gaaaattaaactttcgattgctagagctgtgcttttgaatccaacaattcttctgcttgatgaagtaactggaggactagacttcgaagctgaaagaattgtgcaggaagctcttgatctt

SEQ ID NO: 1829 - DNA, 134 bp, Arabidopsis thaliana
ttaagcaaaactaaaccaaatccaaactgagacaaaataaaagatcatgtagagttacctgcagctgctgcagcacgaggccaaatggtctgaaggacaacggatgtatcagctgtttcaccccacatgcaaac

SEQ ID NO: 1830 - DNA, 117 bp, Arabidopsis thaliana
ccggccgtcgattctatgaatgatcttatctatttatcttttacgtatgtacctcaatatctttggatgtgtgtatgtatgtataggtgcagcacatgatagagaaatgtttgatct

SEQ ID NO: 1831 - DNA, 107 bp, Arabidopsis thaliana
ttcgtcttcttgatcacagttcttagagtctgggatgtgcttctctttgaaggaactcgtgttatgcttttcagaacagcactcgcattgatggaactatatggtac

SEQ ID NO: 1832 - DNA, 136 bp, Arabidopsis thaliana
cgagtcgagcggcggtgaatgtgcggatagaagagtcctggtcctgttcaggagcaaattcgtcctcgtcatcatccacgactatatcctctgattcatcaggatctgaatctgtatcggcgccgcgagcggagat

SEQ ID NO: 1833 - DNA, 89 bp, Arabidopsis thaliana
ttgtaactaatacgcaggtgttgcttttgctttcaatcagtttaggttgccgtgttagagaggagctttgggtatttctgcagactaga

SEQ ID NO: 1834 - DNA, 66 bp, Arabidopsis thaliana
gctcaaagtggcggagaataatagatgaaggtgtatctgttactggttctgcatggttttgtagca

SEQ ID NO: 1835 - DNA, 83 bp, Arabidopsis thaliana
ttgaaggagtttgttgttgttagaacgcttcgtgatgattggtcaatggctcaacgtgaagttgcagagaaccaagcttcttc

SEQ ID NO: 1836 - DNA, 84 bp, Arabidopsis thaliana
gaaactcagggcaacgttgaaaggtctgaagttgataatgatgatgacggtgaagatgttgtttggggagttgaagaacaagaa

SEQ ID NO: 1837 - DNA, 83 bp, Arabidopsis thaliana
tacatatataccaatatatatacgtgtaaattgataaatatgcgtcagtgtgtcacatgagtgtgttagtgtgtgtaaggtca

SEQ ID NO: 1838 - DNA, 135 bp, Arabidopsis thaliana
tttttaaactccaaaaatgcagactccaaaatcaaggtgatgatcacaactctaactttgtgttcttgttgtgaatgttgttggagttattgatctgtttcaaagtgattgtgattgtgtgtgataggccaggat

SEQ ID NO: 1839 - DNA, 76 bp, Arabidopsis thaliana
gttgtgtctgagaatctgagtgatccactttccatagatatggattgtggtatctcagtttttgggagagagaaga

SEQ ID NO: 1840 - DNA, 133 bp, Arabidopsis thaliana
agatctaaacttcatgagggatacacagtattgtgatgatgagatacttgcttcttctgttgaagagaaggaagaggtgcttcaacctcacgagtcgcctgagcctgagaaagttatgaagaaaggaaagtat

SEQ ID NO: 1841 - DNA, 83 bp, Arabidopsis thaliana
catggcactgatgaggtttgagtgatcttgatgttgttcagtctttaaatgatcatcaatcacatgttcaaataaattggtga

SEQ ID NO: 1842 - DNA, 83 bp, Arabidopsis thaliana
tctttctctttctctctctatatatgtaactcacaaataagagacagattgtgtgtgcgtgtgtgtgactgaatgtagaaact

SEQ ID NO: 1843 - DNA, 120 bp, Arabidopsis thaliana
tttggaaagcaagggactgtcgtctcggttcgcgatccacaagtaatcttttgtggagattatgaaaacaatcatcacgagaggctacgtgtgggtggcaaacaaagacgacaatcccta

SEQ ID NO: 1844 - DNA, 98 bp, Arabidopsis thaliana
atctagaagctatatgtacatagatgtaaaggctgacacttatgtcactgtacatatagatagattattgaatgcatatgaaaatgaggaaaattata

SEQ ID NO: 1845 - DNA, 123 bp, Arabidopsis thaliana
actttcatcatcgccggcgcatttttcggtgaacgggtaagagatcagagcctttttggttgtgttatagcttattagggttcgtattgtaccggatctggtttttgtgtgtatggtttgatt

SEQ ID NO: 1846 - DNA, 82 bp, Arabidopsis thaliana
cgtttgctgccgctgctgctgctcgaaccgctgcctcccctatacggtggagaatgccttggtggtggttgcggcatagctg

SEQ ID NO: 1847 - DNA, 70 bp, Arabidopsis thaliana
acttcttattgatgatgatgcacgtcgatttgcatgtacttcttgatgttccgcgtcgtcgttcttgaca

SEQ ID NO: 1848 - DNA, 135 bp, Arabidopsis thaliana
tataagtgcgtctatgttgtggtttttggacttggcaggattcagattctattaaggaacttgtggtgaagtggaactcaatctgtgattcaatccacaaaagaccatctctaaaaacactcacactctcttctc

SEQ ID NO: 1849 - DNA, 129 bp, Arabidopsis thaliana
tgataatgcagagagacgaacaacttcagcagcagcttgagcagctgcaacggctgcctctgcagctgcagcagttgcaatagccacagagtaagcatgtctgctctgttgctcctcaatctcctttag

SEQ ID NO: 1850 - DNA, 112 bp, Arabidopsis thaliana
aagcttgtaacttgctattgaatcttgtatatataaatgtgtttgtgttacagtttcacatgagtctgatcaattgtggcatcattcttttcttgtgtagatttgagcaaat

SEQ ID NO: 1851 - DNA, 122 bp, Arabidopsis thaliana
attgttttttgttatgttttttttttttttgtgtttgaagtcttagcttgttatggtctgtgcaggcagtgtagttttagcttagccattgacttccatgttaactcaaaaggcatggtttt

SEQ ID NO: 1852 - DNA, 133 bp, Arabidopsis thaliana
tcctcaatggaaactataccatcattatcagtatccatcttgttgaacattactttgatgtcttctacttcttccgtagataaaaattcggcaataacctggtttgaataagattagtaaagatatcttccgt

SEQ ID NO: 1853 - DNA, 70 bp, Arabidopsis thaliana
agtactaaagattatggctacgagttttggagacacttttgcatatgtgtttccatgttctagtaatcgg

SEQ ID NO: 1854 - DNA, 131 bp, Arabidopsis thaliana
aggcaaacatggaacaagtaacgtgagagtaattgttaacagaggaatgaataaaatgttttgttttcttgaagctatgtctcacaaacacatctcatattgtacatcattttgtaaagcataacaatcac

SEQ ID NO: 1855 - DNA, 89 bp, Arabidopsis thaliana
agttgtcaactttggtgattgtgtgcatgttagtgaccgctccaatggcgtccgaggcagcaatctcgtgcggcgcagtcaccggcagc

SEQ ID NO: 1856 - DNA, 90 bp, Arabidopsis thaliana
accaaggttacacattttgttgttgtctggtgctattgataaagctcttctgtatgcatcttcagcttccacaaagttgtctcgttgcat

SEQ ID NO: 1857 - DNA, 70 bp, Arabidopsis thaliana
tgatgctgaaacatgatctcttgctgattgtggttttgccataactcaagtgttcctaaagcagcgtttg

SEQ ID NO: 1858 - DNA, 124 bp, Arabidopsis thaliana
gagcttcatttttagtctggggttgtaaaaattgatgctttgtttgtgaaattagagatgaatgttgtgtgattcagaatggagttagtgtaatcttcttaggcgggtgttgtttatgctgttt

SEQ ID NO: 1859 - DNA, 86 bp, Arabidopsis thaliana
tgactggcgctggtggtggcagtgctgcttcctttggttcgtgaaggattgcagatcgtgctgcaaccgctgcctgaaaatagaac

SEQ ID NO: 1860 - DNA, 131 bp, Arabidopsis thaliana
ttgatctcaagatagttcaaagcaagagctttgaaagtacttggtgtgcaatacgacatgtggatgtgcatatccatacgtcctggtctcagcaaggccgcgtcgagtttctctttgtaattggttgtgaa

SEQ ID NO: 1861 - DNA, 74 bp, Arabidopsis thaliana
aaacctcgcaatctcgagttgacagcgtagttcttctgatagattcatgttgttggtggaggcggtaggatcaa

SEQ ID NO: 1862 - DNA, 89 bp, Arabidopsis thaliana
tattttaatcacagtttattttttctaattacataacacatgcttggtctacatagagtctgtgtcactgtgtgattgttttgaataat

SEQ ID NO: 1863 - DNA, 92 bp, Arabidopsis thaliana
gggttttagttagatttatctgtggttgtggatgagtgaaatttactggtttgctttcactggttgtcgtgtgctaatttcgactctacccc

SEQ ID NO: 1864 - DNA, 83 bp, Arabidopsis thaliana
ttcttcatctccattagttttgatgtcaactttcgagttttctcgatgtagttgtattaatgtgatcattggaggtcgagaga

SEQ ID NO: 1865 - DNA, 123 bp, Arabidopsis thaliana
agacaagggtcggtgaggtttggttaagaaggatctgtcacgggaacaaagagaggtctttgatgatgatgatggattcagacgtgcgaccaaaagacgagaccgatgaatgatactttgttt

SEQ ID NO: 1866 - DNA, 80 bp, Arabidopsis thaliana
cttcttcagcttctgccattgcaaattctgcttctgccacagctcttgcagctgctgcagcagcttctttttctgtcata

SEQ ID NO: 1867 - DNA, 91 bp, Arabidopsis thaliana
gacaagtgtacaagacaatgatagctctctatagccaaatatattttggtactctttggattgttgttgctcttgtttgatttccttgatt

SEQ ID NO: 1868 - DNA, 80 bp, Arabidopsis thaliana
tactcgtacacaaggagattcgtttcgtggttggagcaaaaaccgagcagtctcacgatgtgtctgtgtctgattctacc

SEQ ID NO: 1869 - DNA, 79 bp, Arabidopsis thaliana
attctgatattgagattgctcagaagcttgaggaagctagagtgagtcttgaagctgctgctgctgctaatgaagaaga

SEQ ID NO: 1870 - DNA, 82 bp, Arabidopsis thaliana
aatgacaagaaacagtacctgtggtgtggactagtgatctttactcatcactaatcatcatcatcctcttcttcatcgtcat

SEQ ID NO: 1871 - DNA, 113 bp, Arabidopsis thaliana
ttttggtcttgttgaaatcaagtaggcacatttttaacctctgtttcattttgttgcaggcctcgtcttaaatcaccatggtctcggaggaaaaggaaaaggccacttagacc

SEQ ID NO: 1872 - DNA, 94 bp, Arabidopsis thaliana
cagagacagattcaggtaatttcgggatattagggttttgaattggtcgagggatttgagattgttgttgctgagatctgttgaatgaattaac

SEQ ID NO: 1873 - DNA, 87 bp, Arabidopsis thaliana
acttgtccttccggttatttgtttgattcagtcaagcctggtgaaaccattggttttgatgatggaaaaatatggggagtcataaaa

SEQ ID NO: 1874 - DNA, 99 bp, Arabidopsis thaliana
ttcgactacgccatgctcaggtttaatatttgcatgtatctcaactaccaaagaactatgtgtgtttatatctacttgagctgattcagagaaagtttc

SEQ ID NO: 1875 - DNA, 73 bp, Arabidopsis thaliana
ttgcttgcatcatcatcatcatcaagctctaaaacatccaacaagatgattatgactttgattatgacgatga

SEQ ID NO: 1876 - DNA, 96 bp, Arabidopsis thaliana
aaatatatcgtcttatgactcagattatgatgttggctacatgatgaaaaagtgtgttgcaatagaaatcattctgtgtgatttgtaagacgttaa

SEQ ID NO: 1877 - DNA, 88 bp, Arabidopsis thaliana
aaaaatacctacaaggctacaagtacatgtacatgtgtgtttacacgcgtgtgaatggaactgtgtctgtgtgtggtaataaaaggta

SEQ ID NO: 1878 - DNA, 71 bp, Arabidopsis thaliana
gaatgcatgaatgcatgtatgaatgtatgactgaatgtatgaatgcatgaatgcatgtatgaatgtatgac

SEQ ID NO: 1879 - DNA, 97 bp, Arabidopsis thaliana
tatgcatgtatgaatgtatgaatgcatgtatgtatatttgtatgtatgtatgtaagtttgtatgcatgcatgtatgtttgtattcgtgtgtgtattt

SEQ ID NO: 1880 - DNA, 151 bp, Arabidopsis thaliana
aagtatgcaatgtgtataaatgatgcatgtatgtatgtatgtatgtatgtatatatgcatgtttgtatgtgtgtatgtatgtatgatgcatgtatgtatgatgtgtgtgtatgatatgatgcatgtatttatgtattctatgcaagcgtaa

SEQ ID NO: 1881 - DNA, 86 bp, Arabidopsis thaliana
tgatcatcatcatcattttcatcactggattttttaagaaaatcgttttagatttctgtgtgggtgaggctgagctgatgaaggat

SEQ ID NO: 1882 - DNA, 139 bp, Arabidopsis thaliana
atggttgtattgagtgtttatttgttcgcaggaacttttcttcaaaggaacaagatttgccatcttcttcttcttcctgcaaaatcatttctacattttcatacctgcctttatcatcttgtgcctaccaatcttcact

SEQ ID NO: 1883 - DNA, 147 bp, Arabidopsis thaliana
tgtatcattgttttcgaacgatgtccttggagaaatatgcgtcaatggagtccgtcttcttgagaagcatttttgagtgagaatgattctcatgatggatatgtcttcaaggacttctttcaaacaatggtactattcttaatactt

SEQ ID NO: 1884 - DNA, 81 bp, Arabidopsis thaliana
tggggaagagaaccaggttttgaactatcagtctggctactagagtgaggctgagaagactcttcatcatcatcctcatca

SEQ ID NO: 1885 - DNA, 84 bp, Arabidopsis thaliana
gtgatgctgatggagatgaagcgggggaatgtacgtctgctgccagagatgcttcttccgtttcagctgcagcttcagcttcag

SEQ ID NO: 1886 - DNA, 85 bp, Arabidopsis thaliana
gtattcctggatcgaaacaaggctgattcgattactcgctgtcgctgttgttgattttggatctgtgttttgttatcttcggatc

SEQ ID NO: 1887 - DNA, 134 bp, Arabidopsis thaliana
ttgtgtttggtgaatgtttgtctcaatgttttcagtttatggattaatgagatgagtatttgtgtttggtctgaatgtttgtagtttacggttttgtttcatctgttaatgtcatgatttgcttcattttgcag

SEQ ID NO: 1888 - DNA, 90 bp, Arabidopsis thaliana
aagcggagtccatatgattggtgtatgcagggaaagatgatgagccctgcatatatatattagaaatcagagactgagaaacacacaaaa

SEQ ID NO: 1889 - DNA, 96 bp, Arabidopsis thaliana
cttggaaaatgggaagtcctgggaactgagatacacgttcaggatgttgttgttgataatgatgatgatggtactcgggtgcaggagaggtgttca

SEQ ID NO: 1890 - DNA, 125 bp, Arabidopsis thaliana
atctatcttccatcactttcatgtctgtctgtgagtgtgtttcatcttagagttcttggtttttgagcttgaattattgttgaaccgttgtagctccatgaacaaatttggaatcttcaatgtac

SEQ ID NO: 1891 - DNA, 87 bp, Arabidopsis thaliana; identical to SEQ ID NO: 52

SEQ ID NO: 1892 - DNA, 74 bp, Arabidopsis thaliana
cttcatggaatgactctttttctctctgcaaatggactggggtcacatgtagtcggaatcacaagagagtcact

SEQ ID NO: 1893 - DNA, 137 bp, Arabidopsis thaliana
tatcgagaagattgtgactcctgatgttgttgaggttgatgatttggatgagactgttcgtggtgatggtggttttggttctactggtgtctaagtgataatcatcttcttcgtttatgaatgtgttttggttttta

SEQ ID NO: 1894 - DNA, 63 bp, Arabidopsis thaliana
atgtgcatcatcatcatgtgtggtgttgtatgattcgacatcgatgatgatgatggtgatggt

SEQ ID NO: 1895 - DNA, 76 bp, Arabidopsis thaliana
ttttgaagagaaagaggtacagatttgagtgtttctcaaaaaccgttgaacttcctctttgtttcagaatctcagc

SEQ ID NO: 1896 - DNA, 116 bp, Arabidopsis thaliana
agtagaaaatattagcaaccagtcagattttggatctgtaagactcttaccaagtttttttctttcttggcagtgattttgtggtttcattttattgtcctatttgtatgatgtac

SEQ ID NO: 1897 - DNA, 104 bp, Arabidopsis thaliana
ttgctatggtagtgtttgagtgatatcaatgcttctttggtatttgattagatgttagatttggtagtggttgatgtgacttgattgatctatggaagttgttg

SEQ ID NO: 1898 - DNA, 137 bp, Arabidopsis thaliana
tttcgcgttttggataatagtagttctcgtagagttcgaagtttgatcttgttgggagaaactctctctctttctctggggggttatgctttgtttcttctgcaaatttcgctcctttccacacggcacagagtaag

SEQ ID NO: 1899 - DNA, 137 bp, Arabidopsis thaliana
gaatcaaataatcgtggtattcaaatagggaaatttcattctcgttagcaattaccatattgttttctttttttttgataaaatagcatatgtttttcatccttgacattgattttcttggcatttgatttcgatcc

SEQ ID NO: 1900 - DNA, 147 bp, Arabidopsis thaliana
ttgttgctcgagagcttggtggttttgatggtttctgtcgcagagagcgtggttcagtccaatacaccacacaattttgagtgatgtattgtgtgatgcttgtgtcatgttgctgctcagagatgtgttccaattccagttcttctt

SEQ ID NO: 1901 - DNA, 116 bp, Arabidopsis thaliana
ggtttcttgactttggtcttctttgtgatgaacatgtacgggttcttcttgggatttgtttgtgttttggttatgatccctcttttaagtctttcaaatcaagatcgccttatcct

SEQ ID NO: 1902 - DNA, 72 bp, Arabidopsis thaliana
acgtcatagctggtatgtgtgtgtgtgtatcttcccaattacgcgttttatacatatatgttaaaatgacat

SEQ ID NO: 1903 - DNA, 83 bp, Arabidopsis thaliana
attcacgcaattttgttgaatctcatgaaattatataaaacataattacaagatttcatgtgattttgttgaatagcatgaaa

SEQ ID NO: 1904 - DNA, 98 bp, Arabidopsis thaliana
aataataataatcttcttttaaaggctaagtgatgatgttgatgcttaccagatcagctggaaactcggaatggttatcttttcctttgaaaactccg

SEQ ID NO: 1905 - DNA, 127 bp, Arabidopsis thaliana
ttgttaagatatacattttgatgttgattgcacattttttttagaaatacagtttgatgatgatgcttttctctccgatctagacatcgatcgtgtttttcttcgatcaatagatagtgatggtgat

SEQ ID NO: 1906 - DNA, 104 bp, Arabidopsis thaliana
aaagaaccttggaagagcattgatgaaagaagctgttgtcatgattatcaccatcatcatcatcatcatcttcactaacatcattatgtgattttatggtttta

SEQ ID NO: 1907 - DNA, 147 bp, Arabidopsis thaliana
acttatcggagaagttaaaactgttaccaacggttatgtagttggttatgtagttagttatgtatacatctatataagtgtgtatgttgtcttatgtaaaaacagtcgagaaaataacaagcttcagttttaataaaagaaagtctt

SEQ ID NO: 1908 - DNA, 125 bp, Arabidopsis thaliana
tgtttgtctcttttattacaaccgtcaagacactcggaaataatgtctctagaactcatggtgacgatgctgaaagtgactgtgtgtgtgatagtgtttcaaatgttgatgaaaataatgaggtc

SEQ ID NO: 1909 - DNA, 115 bp, Arabidopsis thaliana
tctttccttctccaaattcaatcccaaaagtgatgagattgttgttcttggctatcctctcatggaagaaactccattggcttttgatgatactcaatatcttctcttgcattga

SEQ ID NO: 1910 - DNA, 84 bp, Arabidopsis thaliana
agaaaaggatttggagattttagagacatccatatacacttggtagaggatgctctcttcttcttcaatgtccaacatttgttg

SEQ ID NO: 1911 - DNA, 89 bp, Arabidopsis thaliana
gaagtgtgttgtaaagctactggatcatttcaagcatacgggtcctaatgggaagcatgtttgtatggttttcgagtatttgggagata

SEQ ID NO: 1912 - DNA, 77 bp, Arabidopsis thaliana
attggaattttcaggttttgcaagacaggactgtcaagtgatatcactgttgttgttgatgatgtgaagttccatct

SEQ ID NO: 1913 - DNA, 112 bp, Arabidopsis thaliana
gatccattgagttgtgaatttgttcgttaatttggtatttcttagctaacgtgagttgtttgttgtatatatatagaacgttagaagtcatggcttatggatgtatcatgta

SEQ ID NO: 1914 - DNA, 108 bp, Arabidopsis thaliana
agatatggtttttattttatttttatttttgtaagcagatgtatgcacgattaacaaaagttgtgtgtgcatcttacttacatgtgtgggcatatcgtaggccataac

SEQ ID NO: 1915 - DNA, 91 bp, Arabidopsis thaliana
actaatctagactctcttagtttgtgtggacctggttgatgcatttttgattagatgccagattcaatctcgagctttctgagtgtttacc

SEQ ID NO: 1916 - DNA, 129 bp, Arabidopsis thaliana
aagcgagactttaaaacttagagtgttttgtgtttgtgagaaataatgagagacttggtctctttatatatagtagagagaggtaggatttgtgagaatattctcaggatatggaatattttgagaata

SEQ ID NO: 1917 - DNA, 81 bp, Arabidopsis thaliana
ctgactttgtattatgcaatacttgtatgtgtgtagctgattatagtgattagcttatgtatgagattgttgtatttggtt

SEQ ID NO: 1918 - DNA, 74 bp, Arabidopsis thaliana
ctgcatcaaagttgcatttgacgtatggagcaattggttttgtccaagaagtttgtgatgttgatgttgatccc

SEQ ID NO: 1919 - DNA, 142 bp, Arabidopsis thaliana
ggttgttatgaatgaattgttagaagttaaagcatgttcggttgtttgcttgtgtctaagtttatatgttatgatgatggttgtatagctttaaaaagtattctatgtttcagtgggcagagttgaataacatgccgtcttg

SEQ ID NO: 1920 - DNA, 122 bp, Arabidopsis thaliana
ttgcatcacatttagcttattttgcacacttaggcatttaggatcatcttgcatacatattgcatgttttggtgtgtttgcaggtgctgaaggagcttacaaggcatctactcgacccccta

SEQ ID NO: 1921 - DNA, 91 bp, Arabidopsis thaliana
gagaaatatggtaagcttttgctttgcgtttgtgatgtggttgtcttgatgaagtcgcgagtagcagttgtatttatacaaagtgaaaggg

SEQ ID NO: 1922 - DNA, 100 bp, Arabidopsis thaliana
agagaaagcgattgagtgagagaagtgttgttgttgagattgagagagcaaacaatgatattctttttttcgcattccggaaaaaagaataacctgaacc

SEQ ID NO: 1923 - DNA, 133 bp, Arabidopsis thaliana
gtgaagtgtctagtttagttgtgtaagtcctaagagtccgagtgtaatggaaatcgatgaagtttgtttgtttctttccgaacattagctttgaaatttgagttaagacagtaaatgacaaatcgagtgttgg

SEQ ID NO: 1924 - DNA, 98 bp, Arabidopsis thaliana
aagatacataagtccaccaatagcactcatgtaaggtacttcgggatcaagtatatcttcgtcatcctcacagggtctaaatgggcatttttcaatct

SEQ ID NO: 1925 - DNA, 115 bp, Arabidopsis thaliana
actgatgatgatatttgacatattgtagtagatttatcctttcatatcgagcgtcccaattttgatgttgttagcttcctgtgggtgtttctttctgtgatatgcaaggcatttg

SEQ ID NO: 1926 - DNA, 68 bp, Arabidopsis thaliana
aactacgaatatcaacttcctctgaaatgtgagtgtcgatcgacataatgggagtgtcgatcgacact

SEQ ID NO: 1927 - DNA, 134 bp, Arabidopsis thaliana
tatgtctgaattctgaggcgcaggtgcttgttgttgatgtggtgtgaaaccaggtggtggttgctgttgttgatatcttccttgaaactgctactttggaacgaacccttggctttggttgtaaggaacaaacg

SEQ ID NO: 1928 - DNA, 131 bp, Arabidopsis thaliana
tacataactaatcttttattctggtcaacttgacatgtacatgtgtatattatatatagtatgcatatatacatagaaaacagtcgtagtttgtagtagtgaaaatgaagtaaaggtaataacaaaattaa

SEQ ID NO: 1929 - DNA, 101 bp, Arabidopsis thaliana
aatcttcctttgaaggcataggtcgttgttgtgagatgatctgaatctcttcaagtggaaacagtttctttactcgactccagtaccaatttctcatgtgt

SEQ ID NO: 1930 - DNA, 106 bp, Arabidopsis thaliana
tgaaactgctgctttggaacaaacccttggctttggttgtaaggaacaaacggtttgggttggttctgctgctgctgctgagggtagacttggtcctgagggttgg

SEQ ID NO: 1931 - DNA, 71 bp, Arabidopsis thaliana
atatcagcctcaggagcagcaggaccttggttttgctgatgtgcaaaccgaggtggtggtggcggctggta

SEQ ID NO: 1932 - DNA, 139 bp, Arabidopsis thaliana
gattaccaaacaggccgtagtgggtagaccaatgactacacagactgaatcgggtgagaactcatcttcttcttgatctttggcttggccacttactcgacttgcttcacctaatcatcgaccatggacttgcagtaga

SEQ ID NO: 1933 - DNA, 87 bp, Arabidopsis thaliana; identical to SEQ ID NO: 981

SEQ ID NO: 1934 - DNA, 91 bp, Arabidopsis thaliana
  misc_feature (87)..(91): n is a, c, g, or t
gtagccaaagtcaatatgagtctttggctttgtgtcttctaacaaggatacactacttaggcttatagatcaggttgcggtttaagnnnnn

SEQ ID NO: 1935 - DNA, 71 bp, Arabidopsis thaliana
cccctcttgtacttggaatggttcatcttaagagatgagttgaacatgtttctgctgtacttggaggattt

SEQ ID NO: 1936 - DNA, 104 bp, Arabidopsis thaliana
atatatatatataagatgattattataaatgtggtattagaagttaaagcatgttaggttgattgtgtgtgtctaagtttatatgttatgatgatggttgtata

SEQ ID NO: 1937 - DNA, 92 bp, Arabidopsis thaliana
aaatgaatgtgataggcaataaatccagaacttagccagtcattgtgtggactggtttgtgatggttttgaaatgaatgtgataggcaataa

SEQ ID NO: 1938 - DNA, 97 bp, Arabidopsis thaliana
agaaagtataaagctttgtgagtgtgacagagagagaactcacttaaaataatgtcttcttcttctttgtcttcactaattaagatttgatttttaa

SEQ ID NO: 1939 - DNA, 87 bp, Arabidopsis thaliana
tcggcgggtcatgaaatgaaaggtggtgttgctggtggaagtatcctccaggtatgtttttatctctctgtttctcctctgttctta

SEQ ID NO: 1940 - DNA, 128 bp, Arabidopsis thaliana
aagaaacccgagaagacaaagaacatgaatcaatggtagggttggttaatggatcatgattggttttgtttgggaaagaagcaatagcatcgagaatctctgtccattcctggtcctccgtcgacata

SEQ ID NO: 1941 - DNA, 134 bp, Arabidopsis thaliana
gagacatagataaaaaaaccttttcttagaatcatgcatattgaacatgtgtaagaccttatttatatataagtattctgacttagtgtaaattttgtatgtttttctgtgtttggttatctacgattttcgtc

SEQ ID NO: 1942 - DNA, 151 bp, Arabidopsis thaliana
tctctatggatttgatatatacgagtttcgatatgtgtttgtatattgcatagtagtattattatttttgtgatgatatatatgtgtgattctaatttttgaatattattaggtttcgcttatattttagtctttgatgtataaaatttgt

SEQ ID NO: 1943 - DNA, 73 bp, Arabidopsis thaliana
gtgaagaagaaggtgataaaaagaagaacaaagatcagagacgtgttcttcatcatcatcttcgtcttcatta

SEQ ID NO: 1944 - DNA, 89 bp, Arabidopsis thaliana
aggtcatggtgagcatacaacgctatcatcctagcgaacaagcgtcttgggatggatcgtgtatgtgtgtgcagaatcatgttccataa

SEQ ID NO: 1945 - DNA, 106 bp, Arabidopsis thaliana
agatttgagatccaaagagtctgcaatgatggtgatgatgatttctctttctctagttgttcatctgattcgaagagaacatccatgttcttgcacctctctaccc

SEQ ID NO: 1946 - DNA, 94 bp, Arabidopsis thaliana
ccttgaagtttggtgacatcacattaaaagatgtcactgggatgactccgagttgttgattgagaatgatgattgcttctagttaagggtacac

SEQ ID NO: 1947 - DNA, 99 bp, Arabidopsis thaliana
tttgtttgagaagagtgtttgggtttcatgatgatggtgaaccagttgtgagagcttatgtttgtgagaatggtcatgtctctggtgcttggactgctt

SEQ ID NO: 1948 - DNA, 145 bp, Arabidopsis thaliana
ttcttaatgtgatgttgttcttgatgtctcggtcaatacatttgaagatcgcctatatagtttggatatatatatatatataggggcttttttaaatggttttctatatgacggatgaaagaaaaagggttatttgttaaataaa

SEQ ID NO: 1949 - DNA, 96 bp, Arabidopsis thaliana
tggaagtagagaaagcgacggagatgacgacgacggaggtgaatgtggtggagacgagttcttagtcttcttcttctccggtggttccacttgaaa

SEQ ID NO: 1950 - DNA, 143 bp, Arabidopsis thaliana
ttcttgagtgtgtgagagagagaatttcttaggaatgattatgaagaagatgcaggtagatatgtgcgtgtgtgtatatgtattaaaaggcaaataatctctgttattaaattttggtttattttttcaatgtacaccgactc

SEQ ID NO: 1951 - DNA, 86 bp, Arabidopsis thaliana
aaggagtttgcttagatttactgatgaagaagatgaagatgcttcttccagcttctctgtcattactttgatctcttcttctctta

SEQ ID NO: 1952 - DNA, 75 bp, Arabidopsis thaliana
tgacccttttcacttcttctgcttcttgttggaaaaggtgaagagaagaagcttgtctcagggtaacaatgtaaa

SEQ ID NO: 1953 - DNA, 110 bp, Arabidopsis thaliana
aatgaaaaagttaagtacaagtacaagtacaagacctgatgtgataagagaagccaatgatgaattgaatgcttccacctctgtattctcttctgggcttgtactcaact

SEQ ID NO: 1954 - DNA, 78 bp, Arabidopsis thaliana
ttgatttttgcaagaagaagatgaagccttacttgttgacaagttgtttctatctccaatcttgaaatgagaaatcaa

SEQ ID NO: 1955 - DNA, 79 bp, Arabidopsis thaliana
tccattgttgatgatgctgtcttccacacccttcactgcaaggtataattcggaaagtaaaacattttttgcaatggaa

SEQ ID NO: 1956 - DNA, 62 bp, Arabidopsis thaliana
agtaaaccctgcgttctctctcgctcgcttgtgtgtgatagagagggagagaagaatgaaac

SEQ ID NO: 1957 - DNA, 132 bp, Arabidopsis thaliana
caaacctttcaaaagaaatcagtttgatatgttttgttctacttactaattctttctgtttgtcatatgtttggtagataattgaggaatttcaaaagtgtcatatagaccatccgattgggaaattctttg

SEQ ID NO: 1958 - DNA, 109 bp, Arabidopsis thaliana
ttaagtttcgaccttgttgtgttatgtttgctcaaaattgtgactgatagatgaaacgtgttttgttttgtttctgattgtggtagatatatgtagtgcatttaggcgt

SEQ ID NO: 1959 - DNA, 250 bp, Arabidopsis thaliana
attcacgcaagaaaatcatgaagtctgctgttttgcgtttgggttcttatgttgtcatgtacacataaaactagtatattgccttgaacatggtttattaggaaagacatgagaacatatctgaacatagtttttccttatatacaatgttcaaagtaatgaattagttttattttgtttttcttgttttcatattgtttaaaataacaaacttatgacttcattatttccttttactttgtcataacat

SEQ ID NO: 1960 - DNA, 112 bp, Arabidopsis thaliana
aatatcatgagtgtgcgggttcataatgagtgttttgtccattgattgttgtgacgtgtatgcttaggtagcttgaacggtgtgaatttaatgagcagaggaagggttgtgg

SEQ ID NO: 1961 - DNA, 129 bp, Arabidopsis thaliana
tgtaatgttacagctataggttatgatcatgatcttttataagagattctaaggtatttgtgatttgatcttttattatgatgatcttgaatcttgatttgacattttagacttagatttgcaacaaat

SEQ ID NO: 1962 - DNA, 107 bp, Arabidopsis thaliana
attggttgatcagtagggaaagaatgatcggtttggttgttcttgatatcttctcttccgtacattttaacaagaggagccacgtcgttttctggagtgatcggagt

SEQ ID NO: 1963 - DNA, 81 bp, Arabidopsis thaliana
aattctcagacgcgtgaacatgtgagtgagagagagtgtgtatttataatgtttcttcggctacgttgttcaagtttttgc

SEQ ID NO: 1964 - DNA, 129 bp, Arabidopsis thaliana
caactcacccaaacaaacgctaacatccttagaaattaagcagttgatgatcattacatgtgtttttggtgtcatatgacggattcatcaaatcatgttagaatgatgatgttggaaaagaaacacgta

SEQ ID NO: 1965 - DNA, 138 bp, Arabidopsis thaliana
ctgcaattagatgtgtaggctttagctcaagtgattgagtttcaccctaaagttgctagagtgtgtatatatacatgcttcgccttcggaattagattgaaacttgaatgttgctgcagctcgtgctcttatgttgaa

SEQ ID NO: 1966 - DNA, 91 bp, Arabidopsis thaliana
taatagatttgagaacagcagcaatataagcatgtaaatactcaatccttggtgtgtccttttgttgcagctgcaaatcttgcttcatcgg

SEQ ID NO: 1967 - DNA, 103 bp, Arabidopsis thaliana
ccttggacttcaaattgaaagatcgaaatttttgttagtatttggtttgtttcaaaagaagatgattagagttttgttgttggagtcacaagaattgatagat

SEQ ID NO: 1968 - DNA, 122 bp, Arabidopsis thaliana
aggagtaatgccatcgtcattatattatgcatgcatatatatagtaaattcatgtgggtgtgtaactgtgtatgtatggaactgtaaatataaagatgtggcactattgttagtcaagtcac

SEQ ID NO: 1969 - DNA, 63 bp, Arabidopsis thaliana
taaatatgaatatgtgtatgtgtatgtgtatgcaggagtagacacgtgcacgtggcacatgca

SEQ ID NO: 1970 - DNA, 82 bp, Arabidopsis thaliana
tcaaatatacacacacactcataatcgttgctagctagctaacgatgaatcatgagtttagtggatatatatatgattaaaa

SEQ ID NO: 1971 - DNA, 107 bp, Arabidopsis thaliana
ctaggattaacattgttttggtttcctcaaatgatgttataatgtagttgcatttgtgaatgtaactgtgtgaaatgtcattttactgaattgtgtttgtctctttt

SEQ ID NO: 1972 - DNA, 94 bp, Arabidopsis thaliana
gaatttgcatcatgtgtgatttgggatatgaacaagaagttaagagttagtctttgatgttgttgatcttggtaacattttgatacagaacata

SEQ ID NO: 1973 - DNA, 137 bp, Arabidopsis thaliana
ttcatctttttttaatgctgtcttgttacgggtcaagaattgaacgttcgctgattgttttgaggtcgttgtttgtatgagattttgacctcgcatgttgttgttgttttctgaaacgtccctcttggactaagaga

SEQ ID NO: 1974 - DNA, 67 bp, Arabidopsis thaliana
gtggtgattcttcttcgtcttcttcatcttctgatgatgaagacgagaagaagaagactaagaagcc

SEQ ID NO: 1975 - DNA, 240 bp, Arabidopsis thaliana
tttaggaatatatatgtagagagagcttccttgagtccattcacaggtcgtgatatgattcaattagcttccgactcattcatccaaataccgagtcgccaaaattcaaactagactcgttaaatgaatgaatgatgcggtagacaaattggatcattgattctctttgattggactgaagggagctccctctctcttttgtattccaattttcttgattaatctttcctgcacaaaaac

SEQ ID NO: 1976 - DNA, 95 bp, Arabidopsis thaliana
tttatcctctttttattgcaacattagagagttttgtgtgttgcagctttatcggtgtgtaagaaaaagacttataagcaagcagttgaagtggt

SEQ ID NO: 1977 - DNA, 100 bp, Arabidopsis thaliana
actttattacgcacccttcttttattttcgactgtttcagcttccggttcttcatcggagagagatagagagactgtgtgttttggtgtgactgatagaa

SEQ ID NO: 1978 - DNA, 106 bp, Arabidopsis thaliana
ttttctaattttattgcgagaaaaaatgttgactctttctcttcatgtgttaccacaggatgaagaatctgcttcagggttctcgactatgttagagaaacaacgg

SEQ ID NO: 1979 - DNA, 78 bp, Arabidopsis thaliana
atgaattcttatcaagtaccattctcttctggctccaggctggtgttcttgctggagatgtgagtgacattgtgcttc

SEQ ID NO: 1980 - DNA, 95 bp, Arabidopsis thaliana
acccatttgactctggcgtttacgaaggtgcgtctttgttgcagagctctcgctagctttgttgttgcagctgccattagaacgctaagtgcaat

SEQ ID NO: 1981 - DNA, 67 bp, Arabidopsis thaliana
tgtctctcttttcttgcatgtgtcatttcagatagactatgacaatgcagtaagagagctccacgcc

SEQ ID NO: 1982 - DNA, 89 bp, Arabidopsis thaliana
gcgtagtcaggagaaagttgatgatgaattttgcagatacaatcacgtgaatggtttttgtgtggttgtgcacatccaccattgtcctc

SEQ ID NO: 1983 - DNA, 137 bp, Arabidopsis thaliana
aacattagatagtttagaagtgaaagatcaacatttctttgattctgcagattggggttgtttctgatgatgaattgcttgatctgcttgatcttgccatgtcttctgatacttcaaacacggttataagggcgagg

SEQ ID NO: 1984 - DNA, 121 bp, Arabidopsis thaliana
gatgtatactgtctactcaaatagaatgggtgtgaaaaaaacattacctgaaaatatgtatgaatgtaatttgactaggatattgttggttttttggacattcttattgggtaatctcaaa

SEQ ID NO: 1985 - DNA, 131 bp, Arabidopsis thaliana
cagatctttttttttcttgctcgaagtctacagtcagaatctcaaattatgaatcttggcctctctctgtctttggaacaaaagttggaaagaagaatgtgactttttgacttttgggttttgagtgatgc

SEQ ID NO: 1986 - DNA, 83 bp, Arabidopsis thaliana
atgtgtgtgatgcgtcctatcacatattgtcattgcaaagtgtgttagctcattatgcacatggtggtttagctctttatgta

SEQ ID NO: 1987 - DNA, 114 bp, Arabidopsis thaliana
ttcgtctttagtctatcaatctacatctgcacatgtatcgatgatgtctctcttttgagttgttgtttgtgtgtctgtatgtggaaatgaagaatttgaaggaatgatattttt

SEQ ID NO: 1988 - DNA, 99 bp, Arabidopsis thaliana
aaacattatatagtcaaataagttgagtctctctgtttgattgattagtgaaatatcatcactttgttgatgcgaaaacagagaggtcaaaaagtgaaa

SEQ ID NO: 1989 - DNA, 133 bp, Arabidopsis thaliana
agggtttcctggattgtgggtaattcgttaggacctcttgaaaagattggtgtagtaatatctctctctcttcaattaatttccaactataaaactatttctagattcatctatatacacctaaaaaagttga

SEQ ID NO: 1990 - DNA, 74 bp, Arabidopsis thaliana
aaacaagactcttgcagcagaacttgtgttgtagtttgagagaaaagcagcgcaagatgacttagacttgaaca

SEQ ID NO: 1991 - DNA, 79 bp, Arabidopsis thaliana
tcatacacacacagaaaaaaaaactgtaactgaatgatgattccgtgattttcgttcaatttgtctgtgtatgtgtata

SEQ ID NO: 1992 - DNA, 60 bp, Arabidopsis thaliana
ttgttgaaagtggttttgatttggtctttcgttagatgaagtcaatgtctactgttaact

SEQ ID NO: 1993 - DNA, 95 bp, Arabidopsis thaliana
ctatgatatagtccggttttggatacgtgaaaatcatatcatattgctgctgtgaaaagttaattttcacgtgtccaaaaccagattatctcata

SEQ ID NO: 1994 - DNA, 66 bp, Arabidopsis thaliana
acaatggagcaagctcaggtgtcgtctagtgatgatgatgatgagaaagctgaggccattgaggag

SEQ ID NO: 1995 - DNA, 70 bp, Arabidopsis thaliana
tttatcttcctctcttttagatctgaagcgacgaatagtcactgtgagagtaagagagagagagagcata

SEQ ID NO: 1996 - DNA, 77 bp, Arabidopsis thaliana
acctgctgttgctgctggtatccaccaggctgctggtagtttccatagccgcccccagcataaccaccgtagtaggc

SEQ ID NO: 1997 - DNA, 98 bp, Arabidopsis thaliana
ttactctcgaaaaacttgagcatgtaagcatctttgatctgttaaaagtaattttactggtcagtgtgtgtgtatcagtgtgtatcttctagagtgtg

SEQ ID NO: 1998 - DNA, 97 bp, Arabidopsis thaliana
agattgtctgtggatgttgaacttcaatgataaaacttttcttcagaatgaaaaaaaaaattattagggtgttttgtttgaacgccagagacaagat

SEQ ID NO: 1999 - DNA, 116 bp, Arabidopsis thaliana
atggatcctaacctttgatgtgttcatgatgatcggaagcagcagcagcaatcttagcctcatgatcttcatcatcatcatcgtcatcatccctacgtgatttaacagtgacaata

SEQ ID NO: 2000 - DNA, 90 bp, Arabidopsis thaliana
cttcttctctgctttgattcaacaatttatagaaacttttgactattttccgatcgagaggaagatgatgatgatgatgaagaagagaga

SEQ ID NO: 2001 - DNA, 91 bp, Arabidopsis thaliana
tcacatttccttttatgactgtgctctgatgacattttatgtatgtttgcatcgtgaacagggtcttacctctcatggaagggaacttctt

SEQ ID NO: 2002 - DNA, 139 bp, Arabidopsis thaliana
ttccactttctaatgtttcttgcttaaatgagtattccatgtaaaaatgattcactcactcgtatgggtgggttgggttttctcttcatgagatgctcatttgagcaagcaatgtttggaagtgggactatttaatatc

SEQ ID NO: 2003 - DNA, 88 bp, Arabidopsis thaliana
tgaagaaacctggtgagagagagagaagttggtgaagtggcatgtctgaacatggaccgccaagagcttcctcacatctaagattctg

SEQ ID NO: 2004 - DNA, 96 bp, Arabidopsis thaliana
ttaaaactcttgctatgagctatttgttgttgttctgggggaaaagctttagaagttgaagacgacgatgacgcttttagctctctcttcttctct

SEQ ID NO: 2005 - DNA, 84 bp, Arabidopsis thaliana
aaaaggtcttctaacagtgagtgtttgtgttaaagctttctcggagctatgattcggaattcggtgggtttggatctgcaccaa

SEQ ID NO: 2006 - DNA, 73 bp, Arabidopsis thaliana
aaagacgaagattctacctcatcgtctaggagaacaactaaagatgaagattcttctttgtctcaacatagtg

SEQ ID NO: 2007 - DNA, 137 bp, Arabidopsis thaliana
ccaagtctctccagcgtcttggaaggttccaaggtagtaacagtcatttctcttaatccgtgtttggttttgtttttggctaaacagaaatatcatgtgcttcttcttgcagaagctgcggagtcttgcagagttat

SEQ ID NO: 2008 - DNA, 99 bp, Arabidopsis thaliana
gctgttttggtttgatcttgatttggagttgaagttgaagttgagaagaagaagactcgtgcgttgactggagatggagatggagatggatcggtgaag

SEQ ID NO: 2009 - DNA, 65 bp, Arabidopsis thaliana
cagttggttttgggacattatgcatgtgtgtttatgtgaccaggatcttctgtgaccaaaaaaaa

SEQ ID NO: 2010 - DNA, 72 bp, Arabidopsis thaliana
gtcatcatcaccaacatcttcttcttcttctccggcaaagagagggaagaacaagaatggttctgacaagcc

SEQ ID NO: 2011 - DNA, 135 bp, Arabidopsis thaliana
tgtttttgtgaggatttttgtgtgtctttgattcattgataactcgaatgagcaatcatgatgaagaagaagaagtttttttttttccattttttctttgttaaaatcctatacaaaaaaaaacaaattcaaaag

SEQ ID NO: 2012 - DNA, 87 bp, Arabidopsis thaliana; identical to SEQ ID NO: 52

SEQ ID NO: 2013 - DNA, 106 bp, Arabidopsis thaliana
agatggaactgaaattgctgtaaagatgatcaacgattcttcttttggaaaatctaaaggatcttcatcatcatcatcatcatcccaggtctccaaagaattccaa

SEQ ID NO: 2014 - DNA, 88 bp, Arabidopsis thaliana
cagtctgatgatcttgtcgacccacatcacgaaaaactgttactatcatacctatcatgatgctcatcgtcatcatcatcatgacatc

SEQ ID NO: 2015 - DNA, 90 bp, Arabidopsis thaliana
ttttcaccatcttgcatttgtgttgctttgcactactgactatctatagattatgattttagttaaaacaaatcgggacaagagcatgat

SEQ ID NO: 2016 - DNA, 123 bp, Arabidopsis thaliana
gagagagatctgaaactgatgaagtgcatatgtataataagccatgtgttgtttttttagattttctgcttgtaactgaagcttaggctcgccaattgtataacttcaatgtttcaatgtttt

SEQ ID NO: 2017 - DNA, 99 bp, Arabidopsis thaliana
ttctagattcgattcgtgattcttgtttttgattcttaatgtggtatcatagtttggatcgttcaaaaagttgtaagtcttttgtgtgtgtttgagtcg

SEQ ID NO: 2018 - DNA, 189 bp, Arabidopsis thaliana
agttgctagaagagggagagatggtgattgaggaatgcaacagagaaaactgacagaagagagtgagcacatgcaggcactgttatgtgtctataactttgcgtgtgcgtgctcacctctctttctgtcagttgcctatctctgcctgcttgacctctctctctctctctctctctcaaatttggctta

SEQ ID NO: 2019 - DNA, 84 bp, Arabidopsis thaliana
aatgtattgttaggcttttcttctgattttgttgtttcattatgtatgattaattgaaactgaaggaagtgcttggtggagcag

SEQ ID NO: 2020 - DNA, 80 bp, Arabidopsis thaliana
tttcttcttgaatctcttcatgctgttacttttgctgattttttattctgcagatgcttgtcaaagggaatgtggaggaa

SEQ ID NO: 2021 - DNA, 96 bp, Arabidopsis thaliana
ttttcagggccgaagactccttcactcatagacacctgtgtgaattcgttggtcttgatgtggagatggagattcggaaacactattctgaggtac

SEQ ID NO: 2022 - DNA, 96 bp, Arabidopsis thaliana
ttgactgatcaaaatcaggacgagcatggggcgcaaaaggatgaggctgcggaagatgctgttggagctggtggtggtcatggaatggtgggaaag

SEQ ID NO: 2023 - DNA, 87 bp, Arabidopsis thaliana
tgtgggtgaggaggatgaggaagatgctgcggttgctgctgctgatgcataggatgctggtaagggaactgctgcatagaaggatga

SEQ ID NO: 2024 - DNA, 136 bp, Arabidopsis thaliana
aaataagacaaagtttctttatagtttgaatgagtgtatgttgatccttattgggtttctttccatgtttcagttgtatggaaggcaccttaagtttcaaagcaagtaagtttggtgcggggtatttcatcggttg

SEQ ID NO: 2025 - DNA, 129 bp, Arabidopsis thaliana
ttcttattgaatctcttttgcttactgggtttcttactcgaatgtttgttgttcttgatttacttgcaaatgggatattgattacaacaagctctcttcttgttccttttgcaggctgctgattctcaa

SEQ ID NO: 2026 - DNA, 123 bp, Arabidopsis thaliana
aggaatcctcaagataccagcttgttcaaacccaaactcttcttctgcttcacgcaacagcacatggaaagcttggtggctaaggtactctgttggtatcttgtatcttttctcctccttccc

SEQ ID NO: 2027 - DNA, 94 bp, Arabidopsis thaliana
ttgatgctgatgttgttgttgctgtcatctacgttgtcgatcttgttgttgttggcttgttttgatgcgtgtgcaacttttcgccatttcttga

SEQ ID NO: 2028 - DNA, 76 bp, Arabidopsis thaliana
agatgtgatattggtgccgctagggctaatggtgtatgcatcttaccatgtttacttgtggcataagttacgaaca

SEQ ID NO: 2029 - DNA, 139 bp, Arabidopsis thaliana
tgcagtgaattatcttctgagcaatgttgacaaggtttcagactggaatgaatcacttcagatggtggtgctggagttgattcgaagtgtgtgtaagactaaaccagcagagaaggggaaatatattaagattattatt

SEQ ID NO: 2030 - DNA, 101 bp, Arabidopsis thaliana
cgaatgtggattccttgcagcaaacttatacgcaaaaagtgtatttggtgaggatgctcttgtgaatgtgagtattgagaagcaaacggatggagcattga

SEQ ID NO: 2031 - DNA, 74 bp, Arabidopsis thaliana
aggtttcagactggaatgaatcacttcagatggtggtgctggagctgattcgaagtgtgtgtaagactaaacca

SEQ ID NO: 2032 - DNA, 138 bp, Arabidopsis thaliana
atcgaattgtcatcatcatctcctacatcgtcgtcttcatcatcatcaaaaacagtgcgttcatcatcatcatcgtcagaggtagaagaagagattaactgtatctgagagaaactacgtccgaagggtgagacgtgg

SEQ ID NO: 2033 - DNA, 132 bp, Arabidopsis thaliana
gagatagatgaagccatcaagctgctttctgagatgatggagaatggttgtgaacctgatgttattgttgttaattctttgatcaatacactttacaaagctgatagagtagatgaggcgtggaagatgttt

SEQ ID NO: 2034 - DNA, 142 bp, Arabidopsis thaliana
atctgacagatagagcagtgagcacgcaagagaagcaaatgcatcgaacatgcaaagtgcctttgtgtgctcactctcttctgtcagtttctatgcgtttctcttaaaatttgtcccaaaactccctcatcagtcatcactc

SEQ ID NO: 2035 - DNA, 86 bp, Arabidopsis thaliana
taaacgaaacgtttggttgatagattgagaggttgtagagagctctcaatgcgtcctctctcgcttgtgagctacttgtttcatcc

SEQ ID NO: 2036 - DNA, 105 bp, Arabidopsis thaliana
aagaaagcagagagattagtagtaagtacccaaaattaggtcccatgtaaggctgaccagtgattttgttgcgtctaagcttgtaaagctttcgaatttcaatac

SEQ ID NO: 2037 - DNA, 79 bp, Arabidopsis thaliana
gctcctcttccttgtatccactctggttttgtttgcttgtacaggtgggatcgaccgttggctgatgtaagaggacaca

SEQ ID NO: 2038 - DNA, 120 bp, Arabidopsis thaliana
ttgttgttctaagattgcggagaaagatgagacaatagtaggtcaattttgttggattgtaatattaattgttgaaaaaatccattgtctgtattgttgcttggctttgtttgattctaa

SEQ ID NO: 2039 - DNA, 149 bp, Arabidopsis thaliana
catccataataaataaataaagcatactgggttttaggtcaggctgacgtcagcagtttctttgtgtttcattttttttttttttgtaatctaacgctccagatttgttgtcttctccacgagccctttgttgttgttggtaatggaga

SEQ ID NO: 2040 - DNA, 90 bp, Arabidopsis thaliana
ggctactgtgggatcatcatcttcttcgtcaatatcatcaagatcatcaatgtatgttaaggttaagatggatggtgtggcaatagcaag

SEQ ID NO: 2041 - DNA, 126 bp, Arabidopsis thaliana
taaaaactctatgtgatgaaattatgaatgctgaggatgttgttattacgagcaatgagatgtctttttttaaaaaaaaaaatttggttgcttgcttgcaagaggacatcttagcatcaaatttga

SEQ ID NO: 2042 - DNA, 124 bp, Arabidopsis thaliana
tcccttagttatgtgttttaacattcatatgctgtttgctgcgatcccttagttatatatgtgttcataagttgttgtctgtgattggttctctaggtttttcatgcttgactaaaaaattgca

SEQ ID NO: 2043 - DNA, 74 bp, Arabidopsis thaliana
aaatgggagacttgaagtcatcatcatctttgtgggagaggagttcacaagaagagtgacatcatcgataccat

SEQ ID NO: 2044 - DNA, 100 bp, Arabidopsis thaliana
tttcctttactttatcatcaaccatatctgtatttgaatttgaagggatgtgacgacagcattcccaagttttatattcaacactgaggttgaagactga

SEQ ID NO: 2045 - DNA, 136 bp, Arabidopsis thaliana
attattgtgaagtagctgaatcttttgttgtttatggtttcaatttcagggaaatttggttgatgatgaagatgaggaaggatatgggccacttataggtaaaaaagctcaaacagattaaacagcccaatcctct

SEQ ID NO: 2046 - DNA, 94 bp, Arabidopsis thaliana
gtatcattccagactgctctttcaagaagccgttttgccttgctcccaacaaatattggagatgttggcattgcttcgacaagattctgatcca

SEQ ID NO: 2047 - DNA, 77 bp, Arabidopsis thaliana
gaatccttgtgtggttcaagttcatggtctcagccaattgcttcctgtaggcctctttggatggtgaacttaccgct

SEQ ID NO: 2048 - DNA, 132 bp, Arabidopsis thaliana
agcattttgggtttgttattggttacctagcaagaagttcaagcttgggctgcaagaaactcttcttcttcttagaagtcagagcatacccaacaacgagcttctgctgctgctgcagaaacaaaggttgtt

SEQ ID NO: 2049 - DNA, 105 bp, Arabidopsis thaliana
ctctagttgatcatgagtattctgaattagatcttggtgtgtgtgcaggttgatgcgttcaacagaggatatcatctttggaacaaattagagctcatggtaaaa

SEQ ID NO: 2050 - DNA, 97 bp, Arabidopsis thaliana
gtgggaagtggactgatcaagagactcttcttctccttgaagctttagaaatcttcaaggaaaattggaatgagattgcagagcatgttgctacaaa

SEQ ID NO: 2051 - DNA, 132 bp, Arabidopsis thaliana
cttgtgtctttaattcaaggtgtgttctcatcttcttgtggtgaatgatcatccattagtatttttttttttagtatacaatgccacaagtcatgcgaccatgaaatcaagaaacaagacaccagtcgttta

SEQ ID NO: 2052 - DNA, 131 bp, Arabidopsis thaliana
aatctacaaagtctaagcagaatcaaggtcaattcgcagcaccagtctcgagctctgaatatatgttgatggtgaaacgtatggctgagctggaagataagtgcatgttccttgacttgaaacctgctcat

SEQ ID NO: 2053 - DNA, 131 bp, Arabidopsis thaliana
gattggcttccactccagaatttgacatctggtggaacacctgacaatataaccacacagagagaaagagagttagagctatggagtttgagtgcagtcatattttgaagcttgattagacaataataaca

SEQ ID NO: 2054 - DNA, 78 bp, Arabidopsis thaliana
agatggtggtggggaggagagtggtgatgcaacgaatccaaatccaagtcgtcgtcgtcttcttcatcttcgtcggaa

SEQ ID NO: 2055 - DNA, 91 bp, Arabidopsis thaliana
atttctcttacaaagcattgtcgaaactgactgtaatagttgtgagttgttcatttctgctttcaggtatttgatgctgttgtaggagaca

SEQ ID NO: 2056 - DNA, 108 bp, Arabidopsis thaliana
tttatttctgtcaagggtttgtgaatgaagtcatggctgcaggacaaggaagtcctcttcctcctcctgatgtgattcagattctgttgcaaaatcccgagactgaaa

SEQ ID NO: 2057 - DNA, 114 bp, Arabidopsis thaliana
cggtatgagcggcggtagcggaggaggtggtggcggtgcgactagacccgcgttttagagttttagcgttttggtgacaccttttgttgcgtttgcgtgtttgacctcaaacta

SEQ ID NO: 2058 - DNA, 134 bp, Arabidopsis thaliana
ttcgattctgtgtttacgaatgctgccctggatttgaatttcgcatctccgattcgttcttatgcttcttcttcattagtttgatacttggatctgctcttgatcggtggtttcagatatttctcttcaaatta

SEQ ID NO: 2059 - DNA, 135 bp, Arabidopsis thaliana
accatgtttgtctatcgtctctggttttgtttctttggtttgaaacttaagacactcacatctgtgtatatggatagagatgtgatgtaaatgtgatggctttgaagtttagaggagagatgtgacatgagttgg

SEQ ID NO: 2060 - DNA, 76 bp, Arabidopsis thaliana
atttcgctcagaagatttctctctttctctgtgtgaacgaaggaaacagagcaaagtcagtgctttttcgggagta

SEQ ID NO: 2061 - DNA, 67 bp, Arabidopsis thaliana
cagtaataatcggaccaatgaaatttaaaacatcaattattgctgaggttttgttggttgatgacgt

SEQ ID NO: 2062 - DNA, 84 bp, Arabidopsis thaliana
taagtcttgttgatccacttttggttgttgatatattgctgtgtattcttttaagcaaccaaaagtggacatcaagagctaata

SEQ ID NO: 2063 - DNA, 134 bp, Arabidopsis thaliana
gaatcttaaggaagtaagaagtctatctccaatctgattaagtttctgaaatctgtagcttgatgttgatgctgatttcttatacttaatagcggatgcaggagttatggcggtaagcaggttcatttcatatt

SEQ ID NO: 2064 - DNA, 70 bp, Arabidopsis thaliana
atctctctttctctctctctcttggaacaaagtgtgtttcttggtagtgagtagttgaagtgagagaaag

SEQ ID NO: 2065 - DNA, 100 bp, Arabidopsis thaliana
ttacctaataatacggatctttctttctttctttctttctttcagtagattaaactgatcacagagagagagagagaggctcgatggagtttggtcgtca

SEQ ID NO: 2066 - DNA, 99 bp, Arabidopsis thaliana
tcattggtgaatcgatgagccgggaaaaaagttggtgccgcagatgtacttatacatatgtctgatagttttgcgttcatagcttgattattcaccgcc

SEQ ID NO: 2067 - DNA, 67 bp, Arabidopsis thaliana
gtgttgatggtgatgatgatggtggttgtgatgatcttgctcgtcatcgtgatgatgatcgtgatgg

SEQ ID NO: 2068 - DNA, 87 bp, Arabidopsis thaliana
gaatctctgctatttcaatctcgtcttcatgatgatgatgatgaatctgattctcttcatttgatgatgatgttgatgttgtgatta

SEQ ID NO: 2069 - DNA, 75 bp, Arabidopsis thaliana
acattgctagcttcttcttctacctcatcggatattagattgactagagaagagatagctaacaagtttggttcg

SEQ ID NO: 2070 - DNA, 64 bp, Arabidopsis thaliana
aaatgtggagctttgatgatgttgatgcacgccgtcagcttttcttcacgcctgctcccactca

SEQ ID NO: 2071 - DNA, 78 bp, Arabidopsis thaliana
acttgcgaggaactcaatcttttggtctctgtttcaaacgaatgaataaaacagagctagtaggatttagtgatagca

SEQ ID NO: 2072 - DNA, 74 bp, Arabidopsis thaliana
gttgttttttcttgagcattgttgttgttgtgtgtggaggaaggggatgatgatgctattggaattgacattga

SEQ ID NO: 2073 - DNA, 96 bp, Arabidopsis thaliana
tcctctgcaccacgatcaacaaaaatcccaaaattagaattgtaacttttggtaggggatatttgtgtgtgtcagtgtgtgtatatatatatctca

SEQ ID NO: 2074 - DNA, 115 bp, Arabidopsis thaliana
ggatacattaatatttagatgcatacaataaacatagacattcatgcaaaggcatccgcattcatgtatatatgctacttctttgattcttgactttgtttgttgtttctttctt

SEQ ID NO: 2075 - DNA, 135 bp, Arabidopsis thaliana
ctctgtagtggaagtagttgttgttgttgttgcagaagaatccgaatccaattcaatgagtcttcttcgtcttctcctcgttgttgttgttcttcatctttctgcggtggccggcgacgacgccatcgtctccag

SEQ ID NO: 2076 - DNA, 86 bp, Arabidopsis thaliana
agccatcagttgtttcatgttctggttgttgctggtgcgttaacgcactatagagctgggctatgagagatattgaaggatgttga

SEQ ID NO: 2077 - DNA, 107 bp, Arabidopsis thaliana
aagaacagaaacttgacacacccaaaagaagaaggaaaactcctttttttctttaaatccaagtgtgtgtgtgtatgagtattttgttctgatttggttcggacttg

SEQ ID NO: 2078 - DNA, 126 bp, Arabidopsis thaliana
tgcttaaaaatatagagaattgggtgactgttcatgatcttcttggttttacatgtgtgcttctatgtttcagatatccgcagtttatctgataaccgtctttgtatcaggtgataaatgatttac

SEQ ID NO: 2079 - DNA, 96 bp, Arabidopsis thaliana
tagctgcagaaaatgaagatgaagatgattgcttgttcttcttcttcctcttcttgtaagcctcatcatcatcatcgtcatcaaaagtttgggttg

SEQ ID NO: 2080 - DNA, 137 bp, Arabidopsis thaliana
aactaagatcctcagtgaaagaagagcaaaggagtttgtgttggagctttggaagcaaatgtgttgatgatgatgcaagtgtgtttgtagacgaagatgtgcagtttttactttttacgacttgttaaacctttttt

SEQ ID NO: 2081 - DNA, 98 bp, Arabidopsis thaliana
gattcgagcttctgtttcttcatcaacatccatgccttggatcccaaaattccgacctcttgttgttgatgtccctgaagctttgctgatgtcaaatt

SEQ ID NO: 2082 - DNA, 64 bp, Arabidopsis thaliana
tcacatcaaaaccttctccagcaccaccaccgccacctttggtaggcggtgcaagaaggtccct

SEQ ID NO: 2083 - DNA, 103 bp, Arabidopsis thaliana
gggtcgtttaagtgatgtgttgtgattcgtgagacttgtctgtattgtttgtattctcgttgttcttgtgagtgtaatgtggcgttaatgaaatatgattcaa

SEQ ID NO: 2084 - DNA, 83 bp, Arabidopsis thaliana
caaacatagatgagtgttgtgttgtgattacattagttcttggtcattagtttagttcagttctaaactcgtgttatgttgtt

SEQ ID NO: 2085 - DNA, 82 bp, Arabidopsis thaliana
aagagtccatgctttgtgaggttttgattccgaaaactttgagaaaaactcacctgagaatcagccgtctcaagaatggatc

SEQ ID NO: 2086 - DNA, 101 bp, Arabidopsis thaliana
tgtcttatagtttgctgcttaatagttttcttgttcttcttcagcatttctaaaggggcaacgttatagaaggttaggaaggagcatttgtatagaaagtc

SEQ ID NO: 2087 - DNA, 85 bp, Arabidopsis thaliana
gcatgtttgtataagaatcttgatgtccattgttgttcagggagatctagaattggaacaaatggatgttaagactgcgttcttg

SEQ ID NO: 2088 - DNA, 131 bp, Arabidopsis thaliana
tactcgttgtgtgttgagcttgctttgtgtgttgaacttggttttatgtattgatttgtttcttgttgttagggttaatgaagcaaaaatgatagaagaaattgcaaatgatgttttgcttaaaccgaatt

SEQ ID NO: 2089 - DNA, 104 bp, Arabidopsis thaliana
aatcaacgtcttcgagctcttccatgtcctttatgtcttgttcttgatcttgactctctcgatcacttgcagatgtgacacttgaatcgttcgtctcttgaagc

SEQ ID NO: 2090 - DNA, 112 bp, Arabidopsis thaliana
ttactgccgacgttgctccgaagctgctacaattggacttctagttcaacactgaggtggtggtggtggcgctggaggtggtggtggtgacgttggtggtggtggtggcggc

SEQ ID NO: 2091 - DNA, 89 bp, Arabidopsis thaliana
aatttttaactgcaaacactttgttctttctgttttcagttctaatgtctgaataaactactgagcaagaggtggccatatattgcaga

SEQ ID NO: 2092 - DNA, 85 bp, Arabidopsis thaliana
ctgttgatagccattgcagctttatgaatctgattggtactttctctcttgttcttgagttgttttctggctttatctgacaaac

SEQ ID NO: 2093 - DNA, 130 bp, Arabidopsis thaliana
gtttcagttcttccaatttggggggattttatgttggatccagtctctaaaggttcgattttgatgtgtttccttgatatgtaatcagatttgaatcttaaagtttctatctttatgactcctttcaggt

SEQ ID NO: 2094 - DNA, 67 bp, Arabidopsis thaliana
gctgaagagagagagaatgtggtgaatgatcaaaagtcagtcatgccagcatcttttgtctctttca

SEQ ID NO: 2095 - DNA, 69 bp, Arabidopsis thaliana
tcagggaaatggtttctaactcgggtatggaaaagtctactacttgcagtgatgttgttgctctgagaa

SEQ ID NO: 2096 - DNA, 63 bp, Arabidopsis thaliana
aaaaaactcagagcatatcaagctgtgattgcaaaatatgtgggaagagttttgtgtgttctc

SEQ ID NO: 2097 - DNA, 131 bp, Arabidopsis thaliana
ctgatcccatacaagattctagctcttctactcttgcctccagttcttgcaggtacttgattgtgttgtttagtatcgattctttatcaacctgcacaaagattcaaaacagagtgttggcttctgaaaca

SEQ ID NO: 2098 - DNA, 135 bp, Arabidopsis thaliana
tggtccattgcttgtgcatgcatggttgagtgttttaaggagccacatggattgcatatcattgtgaattgtttagcaccagaactctaggagcaaaagacttctcctatcgtctacgagatgagacgtaaaaat

SEQ ID NO: 2099 - DNA, 81 bp, Arabidopsis thaliana
ttgatctgttttcagtgtcagtgtgtgttcttgagtataagcacttgagcagtgattttagagacagatattatgttttta

SEQ ID NO: 2100 - DNA, 126 bp, Arabidopsis thaliana
tttcgaacaaagtttaggaatatattttgagtgatcattgtaggtttctcaagctggaatgttcttgggttgtcttaccacagccatttcattcttcttgaaggcatggttactattccatctact

SEQ ID NO: 2101 - DNA, 134 bp, Arabidopsis thaliana
aattacgagtttatgataatgttatcatcaatgatgatatctatcatgactatggtatgttgatatgatgatgaagaagatagtatgatgatgatggtgatggtaatatgatattatgagagggtaatgatgat

SEQ ID NO: 2102 - DNA, 106 bp, Arabidopsis thaliana
acgtagttgtcagtttctcaatttcccacttgagcttaaaccagaaaactaaaccgttttctttgcttgtctgaggcacccattgatcccgagcttctccctgcaa

SEQ ID NO: 2103 - DNA, 112 bp, Arabidopsis thaliana
tagacttcagtctttgtctgtgtctctttcgtcttggaacagctcaattttagaagggaggtgatgatgatgaagaaatggcttgaggaacctaaagaatgtagttattttt

SEQ ID NO: 2104 - DNA, 96 bp, Arabidopsis thaliana
catggataagcaattatcagaagttcacatgtgggatgaagtagaccgggtaaggtttgtttatctgtgtgtgattgctgaatagtggttgctagg

SEQ ID NO: 2105 - DNA, 134 bp, Arabidopsis thaliana
attttttcctgggtttgaatgaacatcattgagtgcagcgttgatgtaatttcgttttgtttttcattgttgaatggattaaaagaatttataccagcgttgcgctcaattatgtttttctaattttcaggaac

SEQ ID NO: 2106 - DNA, 129 bp, Arabidopsis thaliana
cgcaacatctatgagcagagcaggcaaagactcgttgaatctgctcacttgattctctgtgatgttttgcttgttcgtcaagaaaacaccaggtctaattctcatttgccctacgatgctttgattaga

SEQ ID NO: 2107 - DNA, 131 bp, Arabidopsis thaliana
agatgttatatgtgtaaaggtggtgactattctatgtaaatgattgttgctgatacttcttgtgttttgttgtaactgtcaagattagagacaagtagtggaggtaatgttgagaaaggttttctaagatg

SEQ ID NO: 2108 - DNA, 140 bp, Arabidopsis thaliana
atgaaacagagtatggtgagaatcagaacaagaagaagaagaaggatcctaaggtttatgagtttgtatatatatataagcttcactaatttgcataaaacatctctgattttggtgttctgattcttgttatttgttgt

SEQ ID NO: 2109 - DNA, 120 bp, Arabidopsis thaliana
caaaggacaaattcagttttagatcaagtcgagagtgtagatcgacacactcttggtgtcgagctacaccagttgcggcctagagacgtccattacgcttttaagtttgaaaaattggaa

SEQ ID NO: 2110 - DNA, 128 bp, Arabidopsis thaliana
ccattcatgttttgagaagcaataggaagcttggttatttttttggagtcaaatatgactgatgtcatgtgtatgattgagtataagaagtagaaccgcaaccgattcccaaaagctaaagtaatgtt

SEQ ID NO: 2111 - DNA, 66 bp, Arabidopsis thaliana
ccaaaagccaaagtagtgtttccttgtttgaagttacaaatccaaagacacatacttactttggca

SEQ ID NO: 2112 - DNA, 130 bp, Arabidopsis thaliana
ctcatttgctcttcgttctcagtctctctctctctcttaaaaatcaatggggttttttttttggtgtgtgtgtctctctctcttattgtctttcagagagtgatgtggggaagaagaagatgatgaaaat

SEQ ID NO: 2113 - DNA, 107 bp, Arabidopsis thaliana
gcgtatgaattgtctcgatttgtgacggattaagttgtttctgtgtctagcgaattgatcttcgtttgatttgattgtgggaattataatgtaaatgtcttatgttg

SEQ ID NO: 2114 - DNA, 62 bp, Arabidopsis thaliana
ttttcctgagccgaaactggtgtcgatcgacaccaagagtgtgtcgattgatactcctcgct

SEQ ID NO: 2115 - DNA, 76 bp, Arabidopsis thaliana
ggattgttggttttgaagttgttgtatcctttgtagccaccctggttgttgttgatgtagctgacttcttccaact

SEQ ID NO: 2116 - DNA, 103 bp, Arabidopsis thaliana
ccttgccttcatcgagcactacgctgctgctaggtaccgagccagacgtccttaagctgagcctgtgtgtgtgttttgatcattttgccttaaatttcttctt

SEQ ID NO: 2117 - DNA, 118 bp, Arabidopsis thaliana
ctgcggtaagagaggttggagttgttggtcttgaagttgttataccctttgtagccaccctggttgttgttgatgtagctaacttcttctaactggttaccctccccatcttggacct

SEQ ID NO: 2118 - DNA, 91 bp, Arabidopsis thaliana
agttttccgtacccttagtctagccttatttcaaggcaaagatcatttgtgtgtgattgtgaggtctttttggattgagcttggtataacg

SEQ ID NO: 2119 - DNA, 136 bp, Arabidopsis thaliana
tctaatatgaagagaaaaattaagtaacttgttctaaaagtctttgagaaccaaagtgttcttgtccttgttcttgatagcattgattgtcttaaactggggcctattacatgaaaacactgtattaaagactaaa

SEQ ID NO: 2120 - DNA, 88 bp, Arabidopsis thaliana
cggactgcaacatcaaatgcaccaccatgaaactgctcttgccgcaaacaatggtaatatttggttttacagcagtttggaacttatt

SEQ ID NO: 2121 - DNA, 137 bp, Arabidopsis thaliana
ttgtccttgaatgatttgttgaatgagttgcttaatttcaggatcttgagctgttggggcttgttgtggttgttgagtgaaccctggtggtggattctgctgttggtagccttcattcaactgttgtttatggacat

SEQ ID NO: 2122 - DNA, 73 bp, Arabidopsis thaliana
agttttagggaacaaaaggtttgaccttagttttagggaacaaaaggtttgaccttgttgttgctgtggagaa

SEQ ID NO: 2123 - DNA, 123 bp, Arabidopsis thaliana
tgtctgattctttcttgtatgtaaagttgtatgtgatctgaatctcatgtggtgttgttggttctcaggggaaagacatgccatggttttggggacatcaggcgatgacaagaaagtgaagct

SEQ ID NO: 2124 - DNA, 95 bp, Arabidopsis thaliana
gaggtacttaatggctcaaacttctcttcttggaaaattgcgatgtttgttgccttagatgctaagaacaagtttgattttgttgacggaacctt

SEQ ID NO: 2125 - DNA, 105 bp, Arabidopsis thaliana
atggttgtgatgatgatggtgatgatcaaggagattagtaccgagaaatctagtgttttctcgatcgatcaatccttgaacatacctaaactcctcaacgtgaca

SEQ ID NO: 2126 - DNA, 105 bp, Arabidopsis thaliana
ggtggtggcataggtgatttagattggtggttttcactagctttcggcgacaacagtggcggtggtgatggtgatgagtgtgtctgagatcttgcttgtttatca

SEQ ID NO: 2127 - DNA, 132 bp, Arabidopsis thaliana
ttgcccgtgaagtagctgttgtagcatctatttcatatcagcgtcagcagcagcaggaccttggctttgctgaggtgcaaaccctggtggtggtggttgctggtaatttccctggaattgctgcttaggacc

SEQ ID NO: 2128 - DNA, 79 bp, Arabidopsis thaliana; identical to SEQ ID NO: 47

SEQ ID NO: 2129 - DNA, 124 bp, Arabidopsis thaliana; identical to SEQ ID NO: 404

SEQ ID NO: 2130 - DNA, 107 bp, Arabidopsis thaliana
gttgcttaggaacgaacccttggctttggttgtaagtaacaaacggtttgggttggttctgctgcagctgctgttgagggtaaacttggtccttaggattggcgaca

SEQ ID NO: 2131 - DNA, 130 bp, Arabidopsis thaliana
caaggtgaagcaaaaagatggggagcctgcaacatgcacatacaccttgattgtctgagtcttccattttggattcatgaatcagtgggccagcttgggctaggacttcttttccgtctctaaagcatca

SEQ ID NO: 2132 - DNA, 93 bp, Arabidopsis thaliana
cagggatgatcgagagtcttcaatacatgactgtaagtagaccagacatctgtcatgcagtgaatgtgtgtgctcagtatcagatcaatccca

SEQ ID NO: 2133 - DNA, 133 bp, Arabidopsis thaliana
tagcaaactcttttttcaagtcaaattactaaacacgacacacataattgaactttactcttcattggctattcaaagaaactacgagtgcaggagcgacgagtgcgatgtaagagaatacttggtgtggagt

SEQ ID NO: 2134 - DNA, 82 bp, Arabidopsis thaliana
aattgttagacatcaatcaatctgctgatgttgagaacgaagggatcaacaaagatgatggtgttgatgcaacttctgaatc

SEQ ID NO: 2135 - DNA, 90 bp, Arabidopsis thaliana
tagcctaagtccatatgagtctttggctttgtgtcttctaacaaggatacagttcatacgcctttaagatccagttgcggtttaagttct

SEQ ID NO: 2136 - DNA, 99 bp, Arabidopsis thaliana
tgtctcttggtctcttgcatggaagacatgggcgtcagcggcgggtccctcgttgtcttcttgtctcttctctgtattctctgttcactagaaaaactc

SEQ ID NO: 2137 - DNA, 104 bp, Arabidopsis thaliana
aactgttgcttaggaccgaacccttggctttggttgtaagtaacaaacggtttgggttggttctgctgcagctgctgttgagggtaaacttggtcctgaggatt

SEQ ID NO: 2138 - DNA, 98 bp, Arabidopsis thaliana
acgcgaagctggaacggcgaggagctccggcgaagtcgagtaaatgaagatgaagatgaagcacggagaggtcgagttgcggtcaagtgagaaggata

SEQ ID NO: 2139 - DNA, 124 bp, Arabidopsis thaliana
ggttgtgttgtgacgatggtgttataggaattattgttagtactagtcatcatctgatgttggtattgatcatgatgatgatactgatgatggtccatgatgtgagcttcaattacagtaatta

SEQ ID NO: 2140 - DNA, 117 bp, Arabidopsis thaliana
gttcatgttgcggtttattcttatgacatgagatgaaggtttgtaaccaagcaaagtaatcgccatcatcatcatcatcaaaaagagacatcaccttaattttgaaaccaagcactc

SEQ ID NO: 2141 - DNA, 135 bp, Arabidopsis thaliana
gtccttggatgatctgttgaatgagttgcttaatttcaggatcttgagctactggggcttgttgtggttgttgagtgaaccctggtggtggattctgctgttggaagcctccattaaattgttgtttagggacat

SEQ ID NO: 2142 - DNA, 137 bp, Arabidopsis thaliana
ttatccatgaatgatttgttgaatgagttgcttaatttcgggatctttagctgttggggcttgttgtggttgttgagtgaaccctggtggtggattctgctgttggtagcctccattaaactgttgtttaggggcat

SEQ ID NO: 2143 - DNA, 88 bp, Arabidopsis thaliana
taatgccatgaagagcattttgcgatatctcataggacaagacgggtatgagtttgatgtagatgatgaagatgacgaagacgtggcc

SEQ ID NO: 2144 - DNA, 105 bp, Arabidopsis thaliana
gttgggaaaagtttgatgatacggagtggacaattcttggtgtagaaggagaatctgagagagagagagtcatggaagctctgaaaaccgcaacttttagcccta

SEQ ID NO: 2145 - DNA, 121 bp, Arabidopsis thaliana
ctgttttataccatttctcatcatttatcatcactttacatgtttaggatagatttgcatgcatgttgcatatttgtgttgatttcaggtgatttgaagctgttgatgagctatctggaag

SEQ ID NO: 2146 - DNA, 136 bp, Arabidopsis thaliana
ttgcatcatatcaccactgttttataccatttgtcatcactctacatttttaggatagttttgcatgcatgttgcatatttgtgttgatttgaggtgatttggagctgttgacgagctaattgggagaagcggacc

SEQ ID NO: 2147 - DNA, 95 bp, Arabidopsis thaliana
attaattgtttcatcaggatgttgttgttgctgcagcattcctagtctgattgatgtaattctgttgctaccaaaatcatcttgactctttaatt

SEQ ID NO: 2148 - DNA, 133 bp, Arabidopsis thaliana
tccaatatccatcatactgcacatttcacacagaaacatcacaagacaattgacttactccagatgctgattgagaaacaggaccttgtggttgtgagccctggtaaagtaaagtaggaaaacacaaatcagt

SEQ ID NO: 2149 - DNA, 125 bp, Arabidopsis thaliana
aacattttcaaacagtgcatcctagttttgcttccgagagaaaaaacgtatatcttggattatgtatagatggattcaatccctttgggaagcatggacggcagtactcattgtgacctgttatc

SEQ ID NO: 2150 - DNA, 126 bp, Arabidopsis thaliana
gctagggaaaatacttctccatattacctccattgttttgctcatcaacttcagttggtcgtcgtcgttgtagttgcaaaaaagcactttgatgttggtggtttttttgacatgatttctaagctg

SEQ ID NO: 2151 - DNA, 62 bp, Arabidopsis thaliana
gaagttgttataccctttgtagccactctggttgttgttgatgtagctgacttcttccaact

SEQ ID NO: 2152 - DNA, 81 bp, Arabidopsis thaliana
ttaactgtgataaatgcatgttaactagtgtattttggagtggtttacattgggtaaaagtattatcatagttatggtcta

SEQ ID NO: 2153 - DNA, 128 bp, Arabidopsis thaliana
ttacttacaaacactatttactattttataaattcaagtccgattttaaaaattcaaatcatgttgtatgttgaagaaaacatacatttttgtgtaataaatttcagaattggaatctacttttttgg

SEQ ID NO: 2154 - DNA, 82 bp, Arabidopsis thaliana
gcagacgatttttactgatgatgaagaggattttaccggcaatgctcgggtccagatctgcatcatcagctgaagctgcagc

SEQ ID NO: 2155 - DNA, 88 bp, Arabidopsis thaliana
ggaattttcgaacacatctcgcatgtagatgggtttgaattcggagtccgactgcgtgagagagatagttttgcgaagattgttatgg

SEQ ID NO: 2156 - DNA, 93 bp, Arabidopsis thaliana
ctactattgatctttgggtgcagattcgtggagttcctcttctatatgtgtgtgaagagactactttggagatagctcaagaattgggagaga

SEQ ID NO: 2157 - DNA, 79 bp, Arabidopsis thaliana
agacgaagaggaagaagatgaagcagaagatggtaagtactcttgaattttcggaattcgtttttgttctttccatcga

SEQ ID NO: 2158 - DNA, 102 bp, Arabidopsis thaliana
gcattacaatgtgaataccttgtctaagtcatcatcatcctcaccaaggaaaactgatgtattcaaaatcttcctagatgagactcttctcttggatgcaga

SEQ ID NO: 2159 - DNA, 91 bp, Arabidopsis thaliana
tttgttccagttagctagtgctactgctatagaggtgaggttaatagttcttaaaggtagtttttagttgttgtgaataggtttagtaaag

SEQ ID NO: 2160 - DNA, 91 bp, Arabidopsis thaliana
ataggtttgagtgtttatttggatgattgattgcttgtttggttgcatgatcatatactctttcattcattgaatgatttcttgaactata

SEQ ID NO: 2161 - DNA, 87 bp, Arabidopsis thaliana
cttgtgataatctctgtttttgatggtttagatatgaatctatttgatagattagaaatagagagaaagagaaagaaaaaatattag

SEQ ID NO: 2162 - DNA, 76 bp, Arabidopsis thaliana
ggggaatccttgcattagatgatgatgttgcaggttgtcttgcatatgcatcttctgcatcatatgtggaggaaga

SEQ ID NO: 2163 - DNA, 133 bp, Arabidopsis thaliana
gtttttgatttgaaacattagatttggttttcgttgtgttgatttgaacggtttccttgattgttgtgtggttttccaaggtacttatgggtcgtgtaaggttagccactcctagtttgagtgaaagtgaaga

SEQ ID NO: 2164 - DNA, 107 bp, Arabidopsis thaliana
gcctcatctactaatctgagttaacgttccttttgcaggctgatgcttttgctgtgaagcttggctatgcaaaagatcttcgtcctgctctagtgaaactacaggtc

SEQ ID NO: 2165 - DNA, 91 bp, Arabidopsis thaliana
aagaaaagcatgtcaagggttgcttttgatctcgatgacgattgttgcgaccgcggtgatggtgttggtggcagaagcgaggaagagatgg

SEQ ID NO: 2166 - DNA, 105 bp, Arabidopsis thaliana
ttataatagcaggactgcactctaatgaaaggttatgttgttgattttctgtgatgacagggacgtttgtaccagtattagagccatcagtttgttccttttcca

SEQ ID NO: 2167 - DNA, 105 bp, Arabidopsis thaliana; identical to SEQ ID NO: 2166

SEQ ID NO: 2168 - DNA, 103 bp, Arabidopsis thaliana
tctgaaagtaatttctcagattctttctcttatgatgatgatgtgattcgtgtttaaattatatgatgatgcttgtgagagtgtgaatgaaatttctcagatt

SEQ ID NO: 2169 - DNA, 90 bp, Arabidopsis thaliana
agacagaattggagagagagtgttggtttgttgtcaatggagtacctataaggtactcaattagagagcatgcattgttgaccggtttga

SEQ ID NO: 2170 - DNA, 81 bp, Arabidopsis thaliana
aagatgaaaggtgtagttgtgtgtgcttcttccacgagtagaagacgatgtggaaggatatgaacatgccagcgaactaga

SEQ ID NO: 2171 - DNA, 85 bp, Arabidopsis thaliana
tacaaattgaaggaaagaattgtgtagttactggagctaattcaggtattggttttgctgctgcagagggtcttgcttcacggta

SEQ ID NO: 2172 - DNA, 94 bp, Arabidopsis thaliana
atctctagaagctgagaaacgaaaggatggaactgatgaaactcctaaaacggcgtcgtgttcttcatcttcgtctcttgcatgcactaactct

SEQ ID NO: 2173 - DNA, 96 bp, Arabidopsis thaliana
ttcctgtggttcttcggtttgaggaatttgcagaagctagagacgatggatacgattgttgttgctgattcttcattggtgatttgggccgcagcg

SEQ ID NO: 2174 - DNA, 110 bp, Arabidopsis thaliana
aactaggactgtgaaaggcttgtggatgacatttaacagttgagattttcatgtgtttgagattcttgtaacacattttgctgtataggtgaaagcttagccacacaaaa

SEQ ID NO: 2175 - DNA, 104 bp, Arabidopsis thaliana
tattacaagcatcttggaattgaaccattgaagttgttgtttgatagatcaaggagagtcagtcaaactgctttgtagaatgtaagagggatgctagtgaagtt

SEQ ID NO: 2176 - DNA, 86 bp, Arabidopsis thaliana
gaaacagtgagtgagagagagagtgaatcattttggttctgtaaggggctgagagagtaagagatctctttgtaaaactcaaaggt

SEQ ID NO: 2177 - DNA, 108 bp, Arabidopsis thaliana
agagatatgatgataacaataaggcatgatatgataatgatgttcatcatgatactgatgatgatgatttattaattattatgatatgatcattattttatcagcctc

SEQ ID NO: 2178 - DNA, 86 bp, Arabidopsis thaliana
tcagtcgacatctcagctgtttgtgtctctgtttcacttctcactcttcggtagaaaagaacatatgcagctgagtttctgatttc

SEQ ID NO: 2179 - DNA, 89 bp, Arabidopsis thaliana
agcgagagagaaagagtcacagagagagagagagagattactaggcaaatccttgctgggtttgtgattcaagatgttgatctcgctaa

SEQ ID NO: 2180 - DNA, 74 bp, Arabidopsis thaliana
gatcaaggacatgatgaagatgatatggctgcagaggattccttgcctagcattgatcctgcctctttgattcc

SEQ ID NO: 2181 - DNA, 122 bp, Arabidopsis thaliana
aggtttagaatttagaatgaaggttttgtatgtgttcatgtgtgcatacattcatgccttatgtgtttgaatttagaatgcaggttttgtatgtgttcatgtgtgcatacatacatgcctta

SEQ ID NO: 2182 - DNA, 97 bp, Arabidopsis thaliana
aagaagaagatcaggcaagattatgagaagaaggagaagcaagctgatgttcgcaagaagatgtgagttttctgatttcaatttttttgatcttggt

SEQ ID NO: 2183 - DNA, 137 bp, Arabidopsis thaliana
gaaaattacctccttgggttggaagtccatcgattttgtctactttgccatcagagcctagatatgtatgtgttggttgttcttatatcgatgttgatggggctgagactttagcagatactgattttcagaagtcg

SEQ ID NO: 2184 - DNA, 76 bp, Arabidopsis thaliana
atcaagaccaacttccagaagtgccttgtagatggtttgatacatcatttgcatggttttgtgctgcagaggttgt

SEQ ID NO: 2185 - DNA, 82 bp, Arabidopsis thaliana
aagaccaacttccacaagtgccttgtagatggtttgatacatcatttgcatggttttgtgctgcagaggttgtgaaaaattc

SEQ ID NO: 2186 - DNA, 107 bp, Arabidopsis thaliana
taaacggtgagaaaaaaaaggaaggtaaatgatgatatagagggcatgggacgacgacgatgtcatcatcatcattgcacctttttcttattaaaaagatagaattt

SEQ ID NO: 2187 - DNA, 102 bp, Arabidopsis thaliana
taaggttttcgcgaaagccgatagagaaagatagagacagagagagagagattctcgtcgctaaatgactctaagccgttcatcagccgacgattcaaccaa

SEQ ID NO: 2188 - DNA, 82 bp, Arabidopsis thaliana
gatgatgatgatgaagaaggaggtagagagagaaagttggcgggaaaaggtggcggacacttcttcttcttcgcatcagaca

SEQ ID NO: 2189 - DNA, 104 bp, Arabidopsis thaliana
tatatatgaatgatatggagatcactgagagagagagagagctattataggttttttttttacaggtttacacgattttggctatcgtttttttttcttctatg

SEQ ID NO: 2190 - DNA, 85 bp, Arabidopsis thaliana
aaggttgttctgagtcaagttgttgtgaggtttttcaggagattagagaggaaaatcttaaggaattttcttagaagaacttatc

SEQ ID NO: 2191 - DNA, 122 bp, Arabidopsis thaliana
actcagttttattgtctgctatgtttctcggggaggtgacaatcaaacagaattcacatatattgtttgattgggatacatttatctctttagttttgatacaaaaagcttacaagtgtttg

SEQ ID NO: 2192 - DNA, 134 bp, Arabidopsis thaliana; identical to SEQ ID NO: 17

SEQ ID NO: 2193 - DNA, 83 bp, Arabidopsis thaliana
ttatatgaattggaaagagagaaggaggaaggagatggaatcgtgaagctactcatctctctctctgtctctcttactctgaa

SEQ ID NO: 2194 - DNA, 340 bp, Arabidopsis thaliana
taaaactaagaggaccaccgagttcagtttccagaagcttcgtacgtagctttctccacgttttagatagtgttatgtatttatttcttacctatagaaacctgtcagctaagatccggactacaacaaagcacgtctactctactatattcttttgcgataatcaatagattcttctaacatcgtaaaggaagacaaaagagtatacatacttagttgtcgtcgtatctttgttgagaagtttctaaatggcacatagaaagtacataaaactatatgaaaccaaggagaaatcaatgaaacttttagagactgaatgatgttgttatcttagttgtct

SEQ ID NO: 2195 - DNA, 325 bp, Arabidopsis thaliana
cagatattcttgactcataagatgtagaaactagagaagagtttgggggaaaactctttcttatgtcttgttgatctcaatagcattgatacaatgtatatatatgcaatttagaatatgtttttcctaatttgaataagaaatagataaacatgaataagtatatatatatttcctatttagaatatttatttattcaaattaggtgaaacataatctaggttgtatatatatatgttataccaatgcgattgagagcaacaagacataataaagagttttcgaaaacttttttctagtttctacataagaggagatctgacaa

SEQ ID NO: 2196 - DNA, 85 bp, Arabidopsis thaliana
aattggatcagaatcatagtgcagttttggaaggttgcggtcagaatctaaccttgataagcttctgagctggtcttagtaggca

SEQ ID NO: 2197 - DNA, 79 bp, Arabidopsis thaliana
caaaaccaagtttagttgtgtatgcatgtagctgttgtcccctaaacagagttccatcagctgaacatgcaaccacaag

SEQ ID NO: 2198 - DNA, 135 bp, Arabidopsis thaliana
cccgattctgatttgatgctgattcttcagacgacagcgaagtggaggaacaacactgattgctgttcttggggtggtatctcttgtgatcctaagacgggagtggtggttgagttagacctcggaaacagtgat

SEQ ID NO: 2199 - DNA, 104 bp, Arabidopsis thaliana
cttggatatatggggtccttttagtattgagtctatagaaggttttagatattttcttactgttgttgatgattgtacaaggaccacttgggtttacatgttaa

SEQ ID NO: 2200 - DNA, 108 bp, Arabidopsis thaliana
cagagctaaggcgcttatcttctttgatattgcatggagtatgcttctacttctctaggagatgcgttttatggaaatatcaaagaagataagcgccttagttctgaa

SEQ ID NO: 2201 - DNA, 136 bp, Arabidopsis thaliana
cgtctccttaaggttcatatctcttcttgctgtctatatatgtcttaaatcagaatatgttttctctctctctcgataactcttgttgggggtgaagtttgataagaggggaacaagaatgaggtaaggagataga

SEQ ID NO: 2202 - DNA, 102 bp, Arabidopsis thaliana
tccatgcctgaaaactctatggctgatgaagtcaaaacatcaatcgcgtgacgccattcttgaactgtgcttttgcatgccatagtttctccaatgacatta

SEQ ID NO: 2203 - DNA, 104 bp, Arabidopsis thaliana
ttcaatagtttgggtaataaaatctatatctatgtggatgtgatgaaatgactaacatacttcagttgcatgatcatgattatgaatatagattcacccatgat

SEQ ID NO: 2204 - DNA, 107 bp, Arabidopsis thaliana
taaaagtttgagagtatggatgacacaatttgacccacaacatatacaacaaccacctgtaggtgtgtgtacatgtacccgggccaacatgttcccatgcgatcgaa

SEQ ID NO: 2205 - DNA, 79 bp, Arabidopsis thaliana
atatgatggtttgtgcatgagcatgaagattcatttagacgacatcaactttgaatacttcatagcgtcttgcatagct

SEQ ID NO: 2206 - DNA, 103 bp, Arabidopsis thaliana
attataggttcatgtatctttttaatgtgtgactgtgactgtgactaatacatggttgtgtttgaatgttagagaaacactcacaaactaagaaaatgtggat

SEQ ID NO: 2207 - DNA, 133 bp, Arabidopsis thaliana
catcacatgagtatgacgagacgggtccatggatttctagtttctttaagaactagaaagtggttttgttttctttacactatcaaatttatgtgaacacctaaaacaaaatatcaaaagaaagtaacaaaac

SEQ ID NO: 2208 - DNA, 97 bp, Arabidopsis thaliana
gttgcttttgttttttacacgatttttgttttgatttgggcttctgaatagaagtctcatgtagatgatgatgatgatggtgaagaagaagaagata

SEQ ID NO: 2209 - DNA, 109 bp, Arabidopsis thaliana
ttgtttttaagtggttaaattgaaattgatgttgatcttggttgttctttctgctgcagaagaaagataataccaatcctgttgattcgaagctcacggtacgtcgctg

SEQ ID NO: 2210 - DNA, 90 bp, Arabidopsis thaliana
gcatcataagtgattaacatagagatattgataaggggagtttgttacctgatacgagtagtgtgtgtgtagatcaactgatgacatgaa

SEQ ID NO: 2211 - DNA, 114 bp, Arabidopsis thaliana
gaactaaaaaagcagagaaacactaattaagtttttggttttgttgttgttgataaatgaaaatagaaaagatgctttgtttgtgatctctctttttggtaatgtgtaatgctt

SEQ ID NO: 2212 - DNA, 133 bp, Arabidopsis thaliana
agggtatcgtttgctctgataccatatggaaggagaatgtattgactttattaagaatgtaatgtacatatttatactaagatacagacatatgattagggattgattaattacaaacatgtcctttaagaca

SEQ ID NO: 2213 - DNA, 82 bp, Arabidopsis thaliana
gtcaattgtgaagtagcaagcggatcagagagagattgaagctgtttttgcttctaaattccttctgccacgttttttttct

SEQ ID NO: 2214 - DNA, 120 bp, Arabidopsis thaliana
aataatagtcgtgcctggctccctgtatgccacaagaaaacatcgatttagtttcaaaatcgatcactagtggcgtacagagtagtcaagcatgaccaaagcttatcataatatctacat

SEQ ID NO: 2215 - DNA, 133 bp, Arabidopsis thaliana
agaaaaaagatgataagaagcgggtccatacaccgggtcagatttggcgtgccgtgtccaaagtgcttcaattttgactaaaccattcgatttttctttttattttttagtatttttttttttttagttttat

SEQ ID NO: 2216 - DNA, 98 bp, Arabidopsis thaliana
ttataaaggtatgcttctgactcaaatatccttggtttttgtgatggagcatgaattaccgtttcaagtatttgataggagcttttgctgttatatct

SEQ ID NO: 2217 - DNA, 86 bp, Arabidopsis thaliana
aataaacctaatgcaatcctgtctctctgttcattatcaggtgttgaaaatttgagtgaagcaagagaagtggaagtgttgtctat

SEQ ID NO: 2218 - DNA, 131 bp, Arabidopsis thaliana
gaagagagactgttgctaagaccttgcttcttgaagaatagagttaaaacagctttagcttcttctttctctgctgcgatcagatttggaggtacaggtcttggactaaactctactctattctttaaacg

SEQ ID NO: 2219 - DNA, 134 bp, Arabidopsis thaliana
gtgatagaggagaaggacctgttggtggtggtattgacaatgaaccggtgaatgtagtagtggtggtggtggagccaggcagccagcggcggaagatgtggtgacggtcaaggatgctacttcagtttttcttt

SEQ ID NO: 2220 - DNA, 100 bp, Arabidopsis thaliana
gaagctatcagtcatcacttgcaatcatttgatgttggtcacaatcttttctcaggagaacttcccaaatcattgatcaactgcagtgatatcgagtttc

SEQ ID NO: 2221 - DNA, 90 bp, Arabidopsis thaliana
cgggtctgtcattcctgatgctcatgatgctgaatctcattctttaacaaaatcactggcggaaaaggttgaaaagtttgtggcagagta

SEQ ID NO: 2222 - DNA, 146 bp, Arabidopsis thaliana
aaactgacagaattagtaatcggagaagaaactgtatcttcttcatcttgcttaaattgcattctttttttttttttttttttgaacaccaattagtaatcggagaagaaactgtatcttcttcatcttgcttaaattgtaccatt

SEQ ID NO: 2223 - DNA, 62 bp, Arabidopsis thaliana
agatttttctcggtcttcatggtttccatatttttggatgatcatgttgatcgttgatttcc

SEQ ID NO: 2224 - DNA, 120 bp, Arabidopsis thaliana
acttgaagtgtttcttttagtagaagaatttcttcaaatctctgtgaattatgccacactaaatttatgtgtgtgtgtgtaatagggttaatttgaagctagtgtggttatacttctctt

SEQ ID NO: 2225 - DNA, 327 bp, Arabidopsis thaliana
gaagaacctctgtagttaggtattcaaggattgaagtcatgtagacaacatcagtcgcaccaacactactatgtgcagaaactctgttcttaagttgcttgtgaatacgagccacttgaaactgaaagaaacaaagaaacaatatcagtataaaattttatcaaattatactacaaaaaatgaaatttctttgtttatttcaatttctagtgggtcgtattcacatgcaactcaagactagagtatctacaacatggtcgacttggtgctattgttgttgactacatggcttcaatcctagagtgcctaacttcataggttattgag

SEQ ID NO: 2226 - DNA, 136 bp, Arabidopsis thaliana
tttttttcccctgggtttgaatgaacatcattgagtgcatcgttgatgtaattttacttattttattccattgttgaattaattaaagaagtatatatcagcgttgcattcaattatgtttttctaattttcagga

SEQ ID NO: 2227 - DNA, 81 bp, Arabidopsis thaliana
aagtctgtgttgttgttgttgagtaaaggattttaaactagcaagtcagaatttctacattcactaacaagcactaagatt

SEQ ID NO: 2228 - DNA, 68 bp, Arabidopsis thaliana
gtggtaatgcaagtggatgtgactgtgtcaatggttgtggcagtggctgcctttgtgaagccaagaat

SEQ ID NO: 2229 - DNA, 77 bp, Arabidopsis thaliana
tcactggaggtggtgggctgtggtgaaccatgggcggtggtggactgtggtgaactaccggtgctggtggaggagat

SEQ ID NO: 2230 - DNA, 62 bp, Arabidopsis thaliana
catgtgtgtgtgtttgtcttggaacatacatgttcaatgacagacctttatgcacgtgttcg

SEQ ID NO: 2231 - DNA, 62 bp, Arabidopsis thaliana
catgtgtgtgtgtttgtcttggaacatacatgttcaatgacagacctttctgcacgtgttcg

SEQ ID NO: 2232 - DNA, 62 bp, Arabidopsis thaliana
catgtgtgtgtgtttgtcttggaacatacatgttcaatgacaaacctttatgcacgtgttcg

SEQ ID NO: 2233 - DNA, 62 bp, Arabidopsis thaliana
catgtgtgtgtgtttgtcttggaacatacattttcaatgacagacctttatgcacgtgttcg

SEQ ID NO: 2234 - DNA, 62 bp, Arabidopsis thaliana
catgtgtgtgtgtttgtcttggaacatacatgttcaatgacagacctttatgcaggtgttcg

SEQ ID NO: 2235 - DNA, 105 bp, Arabidopsis thaliana
ggtctaggttcctctagtttgcgagcaactgctgttgctggtcttgtgataggtttaatgaccagtattgtagtcatggcctcgttattaatcaggtatatgcag

SEQ ID NO: 2236 - DNA, 140 bp, Arabidopsis thaliana
tcgcttgaagaagcgacggttatgggatggtggcggagagagagccgttgtggttttaggagagggagtgacagagagagaaaatatggcggagctttgcatcgttgagatctgaaatcaaaagttgttgatgagagtga

SEQ ID NO: 2237 - DNA, 64 bp, Arabidopsis thaliana
aaagttctgggctttaccattctaagaatgtttcatttgatgatgttgtagagccgcagaatac

SEQ ID NO: 2238 - DNA, 92 bp, Arabidopsis thaliana
cttggtcacatactgaaacctcctgaattgtaaagctccagcttcccaatctggtgggtttcaagatgttgatggagaaactgaagagagac

SEQ ID NO: 2239 - DNA, 124 bp, Arabidopsis thaliana
ctataccagaaagctgatgccctgggagctgcctctcaggctgcgaggatcttgtcttcaatctcttgatttcctggtagtagtagtcatcttcgggtagatcccatggctcttcatactctga

SEQ ID NO: 2240 - DNA, 91 bp, Arabidopsis thaliana
actccttctaccgtcatcttcttcttcgtctacgagagttctttgttctaagttctgagttcagggaagaaagaagcggtgaggagaacaa

SEQ ID NO: 2241 - DNA, 79 bp, Arabidopsis thaliana
atgaaagttctcacactcttactctctctagatctcagttggtttagctgagtaatgtgtgattgtgtgtgtggtagac

SEQ ID NO: 2242 - DNA, 101 bp, Arabidopsis thaliana
aagtttgtgaaatggtatatgggtttttacactggctcgaagaagaagagttcttggtgagctctgtctctctgcttaagtcatggtctctgtttcccctt

SEQ ID NO: 2243 - DNA, 118 bp, Arabidopsis thaliana
aaaataagattgtttgggcttaagaaaaccttctttgttatgaagctgttcaagattacattgtgaatttgtgattggttatatagtgaagtaggtaagttgagttgctctataaagt

SEQ ID NO: 2244 - DNA, 96 bp, Arabidopsis thaliana
agtagtaattaagtgcttgtatatagtatatacagtatatgtatatgtgtgtgtgtcagtgtgtataagttcttcctacattattaaaatacacaa

SEQ ID NO: 2245 - DNA, 77 bp, Arabidopsis thaliana
aaaagtacgcattcctcttttattggttgatcctcatggatgagtgagaatgttggatggattgtgttactctttaa

SEQ ID NO: 2246 - DNA, 106 bp, Arabidopsis thaliana
ctttccacgtgtaacattctaatttgttgacttttcctccattatttgttgaattgtcaatttgttgtttggttgcagaatggtgtgagaggtataatgctagata

SEQ ID NO: 2247 - DNA, 139 bp, Arabidopsis thaliana
tttcgtcggaagaagacggaggatgatgaagatgatgattgatacgagtatcgtaaaccgaggaagaagaagaagatgaaatcaatttcttatctcccatcactctctgcttcttctcttctctttcttctctctgtga

SEQ ID NO: 2248 - DNA, 77 bp, Arabidopsis thaliana
tcaacctcttttgtctattttggatgatgtattttcggaagttgattctctttaagatgatattatttaggttgact

SEQ ID NO: 2249 - DNA, 104 bp, Arabidopsis thaliana
atgtatgtttcaaaaatgaccttatcctctttgcagattcttcacttgctcaggtgagagtcttagaaaagttttggagaagttctatttgacgtgaaaaagaa

SEQ ID NO: 2250 - DNA, 87 bp, Arabidopsis thaliana
gatctaatcaataaatcaagaaagcaaatatatatgcatgtgtatgcatgaatgaatgtatgaatgtatgcatgtatgaatgtatga

SEQ ID NO: 2251 - DNA, 70 bp, Arabidopsis thaliana
tgaacgtatgaatgtatgcatgtatggatgtatgaatgtatgcatgtatggatgtatggatgtatgcatg

SEQ ID NO: 2252 - DNA, 137 bp, Arabidopsis thaliana
gttacgtcttgcttctatattgtagtttctcgatggtggtgataataagactcttgagcgttgttgttgatgatgattaagcacttgatcttgaactcgaaccaaagccttgatgcatcttaaagtgagttttgctt

SEQ ID NO: 2253 - DNA, 110 bp, Arabidopsis thaliana
taggtttatgaattatgtgaggtagagtgagtagatgtagatgtttgtttgatgaaatcaacttgttacatttgtgtataaaattcgtcaaccaatgaaattgaagttaa

SEQ ID NO: 2254 - DNA, 82 bp, Arabidopsis thaliana
atctagttgttgctgttgatgatgatgggttgtttactgagagaattacccacttcagtggccgttatgtcaaagatgcaga

SEQ ID NO: 2255 - DNA, 128 bp, Arabidopsis thaliana
tcggtgttgtgagtgattttggtggttgaatttattgctgctttattgctgtttattcgtggttgttgtctgaatttttttctggtcctgcattgggattcactaggtcaaagatgtattccttccat

SEQ ID NO: 2256 - DNA, 109 bp, Arabidopsis thaliana
taatgaactgtgttcttgattaaacccatctttttttttgtttttttaagaaatcaaattgagacagaagaggaaagaagagaagtctgtgattagagcaaagaagaag

SEQ ID NO: 2257 - DNA, 139 bp, Arabidopsis thaliana
attcagccaaaaactgaccaaaatgcccttgacgaaactgaatccggtttgtacgtacggaccgcgtcgttggaatccaagagaaccgggtttgtacgtacactgttcatcgacgagaaatgcattaaatgttttctgg

SEQ ID NO: 2258 - DNA, 127 bp, Arabidopsis thaliana
tctttcatttatctttaactgatgataatatgtttagtaacgcttataatatcgtttttgtgatttgtaactgtttaaagcggtataattcataccggtactatctactgttcgtttttcacaattt

SEQ ID NO: 2259 - DNA, 71 bp, Arabidopsis thaliana
ttaattgagttgccgcagctgtcgcttgaaattccagtgactcttctctctttctgcaacacctctctctc

SEQ ID NO: 2260 - DNA, 108 bp, Arabidopsis thaliana
cgttaggtttgttttcgaaattgttcgcttttgatgaagaagacgacgatacgcgtttttctcaattggacccgtaatttctggaaatttctgaaagcatccattttt

SEQ ID NO: 2261 - DNA, 68 bp, Arabidopsis thaliana
actgattttttgtgatgagtgtgcaaatgcttgttttagaaggaagaagcctgtgcgttcttgtcaac

SEQ ID NO: 2262 - DNA, 145 bp, Arabidopsis thaliana
ttgtgtatttagcttggttcatcattttaataaggcacatgtgaatcatgaatttgttaatttgttgatgatgatgatgattattgttatgtgaattggtaggtgatgattatacttagttgttgtcttgtcttgtctataattc

SEQ ID NO: 2263 - DNA, 65 bp, Arabidopsis thaliana
tcagctgatgatgcagatctggacccgagcattgccggtaaaatcctcttcatcatcagtaaaaa

SEQ ID NO: 2264 - DNA, 100 bp, Arabidopsis thaliana
gagagccggagagattgaagaagaaaggagaaatatttgcgaacccccaagaatcgtttttgttgattgactctctcatggaaaatctctctcattctcg

SEQ ID NO: 2265 - DNA, 125 bp, Arabidopsis thaliana
tgtatctatttgatggtttgtgaatcattactttttgctgaacatgattatgtatttgatctctttctgtttgtgagcatgattttgttttgtttttcttaagtgtactgaaacagatgataaag

SEQ ID NO: 2266 - DNA, 110 bp, Arabidopsis thaliana
ttcttcttcttcttcattgtattcattcgaaagtgagagtttgttattctgttgtaacagaaagctgagagactccattgttgtgagctcgagcttgagacttgttcatc

SEQ ID NO: 2267 - DNA, 224 bp, Arabidopsis thaliana
cagggactaataatgcaaatatggaaatcttctggggcaaacttgagcttctgaaaacttgaaagcgtttagggtttttgctgggccgaaactggtgtcgaccgacaccaagagtgtgtcgctcgacactcatcgctgattcctgaaccaaaatcgttcttagtttccttttccttagtttttgctccaaaatgtctccttatctccattgttgtcccattgca

SEQ ID NO: 2268 - DNA, 86 bp, Arabidopsis thaliana
gaggttgggattgttagttttgaagttgttgtatcctttgtagccaccctggttgttgttgatgtagctgacttcttccaactggt

SEQ ID NO: 2269 - DNA, 94 bp, Arabidopsis thaliana
gtgtgtaaacgaatctggttggggcagctgcaggtgtcgatcgacactcaggggtgtgtcgatcgacactcatctcgtcacctgcaagaacaac

SEQ ID NO: 2270 - DNA, 81 bp, Arabidopsis thaliana
agtatcattgtctctcttttgtgaattgttttcttttgtcatagttagtatataagtttgagttatttgtgaatgttgtct

SEQ ID NO: 2271 - DNA, 95 bp, Arabidopsis thaliana
cgtcatggactttgctggaccaaaactggtgtcgatcgacaccaggagtgtgttgatcgacactccctctgaatttggaactgaaatcgtcctta

SEQ ID NO: 2272 - DNA, 110 bp, Arabidopsis thaliana
gaggattagcaacgttggtgctgcagtaggagaggttggggttgttggttttgaagttgttataccctttgtagccactctggttgttgttgatgtagctgacttcttcc

SEQ ID NO: 2273 - DNA, 90 bp, Arabidopsis thaliana
tttaagttggagtgtgaattggtttgtgagttagtgaaaaactcagtagtctttgtagcctacattcatgctttgttttcaccttaatat

SEQ ID NO: 2274 - DNA, 101 bp, Arabidopsis thaliana
tcatctttgagactgtttgtttttgttttttatgtacagtttgcttcaaaggttacttttggttgtgacatgttgtaggacgtttctggactgtttcagac

SEQ ID NO: 2275 - DNA, 137 bp, Arabidopsis thaliana
ttgtccttggatgatctgttgaatgagttgcttaatttcaggatcttaagctgctggggcttgttgtggttgttgagtgaaccctggtggtggattctgctgttggaagcctccattaaattgttgtttcgagtcta

SEQ ID NO: 2276 - DNA, 75 bp, Arabidopsis thaliana
tgtgtgtgtgaatgtaagctagattgaatgtctcttccaagtcgtccttgctcccttatataggtctacgcacgt

SEQ ID NO: 2277 - DNA, 122 bp, Arabidopsis thaliana
tttgtattttgttaatgataggatccgttgaattctgttgatgctgagtatttgagatcattagttgtggaatctcggagagtcattgagttggaacaagctagatatgaacaacaacaagc

SEQ ID NO: 2278 - DNA, 103 bp, Arabidopsis thaliana
taaacttgaaagcgtcttggactttgctgggccaaaactggtgtcgatcgacatgtccattgttgtcccattgcatagaatacttgaaaagacactgaaaaga

SEQ ID NO: 2279 - DNA, 134 bp, Arabidopsis thaliana
gtccttgaatgatctgttgaataagttgtttaatttcaggatcttgagctgctagggcttgttgtggttgttgagtgaacgctggtggtggattctgctgttggtagcctccattaaactgttgtttagggaca

SEQ ID NO: 2280 - DNA, 81 bp, Arabidopsis thaliana
accaagattcagcatcatcaacatagtagtcggcatccatagatgattcgtagctgtgtgaactcatcttgaagctgaaat

SEQ ID NO: 2281 - DNA, 73 bp, Arabidopsis thaliana
ttgttggttttgaagttgttgtatcctttgtagccacactggttgttgttgatgtagctgacttcttccaact

SEQ ID NO: 2282 - DNA, 112 bp, Arabidopsis thaliana
attagagaagggtatagaggttgacaagggaaagattgaagtgatgatgtagttgcagccaccaaaaacggtcaaaaacatcaaaagtttccttggtcatgctgggttctac

SEQ ID NO: 2283 - DNA, 84 bp, Arabidopsis thaliana
atgatggcgttaataatggaggagcacccattcgagcataacagttggagtggtggcgtggatgctgctgatgttgaacaccaa

SEQ ID NO: 2284 - DNA, 79 bp, Arabidopsis thaliana
agactgcacaatgttgtgaatgctgtgagtgacattcgtaataactgaagacaagcaacaacatcttattgtagtcgat

SEQ ID NO: 2285 - DNA, 120 bp, Arabidopsis thaliana
ttttcctgttttcaaccattctactcgatcactgtgtgactgtgtgactgtgtgactgtgtgatatagtaaactggtccatttctgcattttcactatctgtcatcctatgtattcgatc

SEQ ID NO: 2286 - DNA, 93 bp, Arabidopsis thaliana
tctcaatagggatttagaaaggattagtagatcgaaaaccccttaggattattcttagagttcttcatcttgatcttgattattcttattgct

SEQ ID NO: 2287 - DNA, 89 bp, Arabidopsis thaliana
gtctatggtttttgttgggccgaaactggtgtcgatcgacaccaagagtgtgtcgatcgacactcctcgctgattcctgaaccaaaatc

SEQ ID NO: 2288 - DNA, 113 bp, Arabidopsis thaliana
ctaataggatgtaaaggatttatttatagagaggatctttttgctgctgatggtttcttgattgaaccacattgacatgagacatgattcgattttgtatctgttatcctgtt

SEQ ID NO: 2289 - DNA, 87 bp, Arabidopsis thaliana
tgcgatgaatgaatacgcttttgtgaaaagaaagagagtcagttttgaagctcttttcaatcagggagaagcagtagaggaatcagc

SEQ ID NO: 2290 - DNA, 80 bp, Arabidopsis thaliana
atcaaatgaaatgagttatgggttgacccaactcattttgttaaatgagttgggtctaacccataactcatttaatcata

SEQ ID NO: 2291 - DNA, 98 bp, Arabidopsis thaliana
ccaaacttcttccatggtgacaagagatctcttctgggcttgagagtcttgagaaggtaaaggagatgatgatgaggttgatgatgatgaagaagaag

SEQ ID NO: 2292 - DNA, 82 bp, Arabidopsis thaliana
catatagaattttatagagagagagagttaaagatacttcattcttgcctaatagacggacgtgtgtgtgtctctctctttg

SEQ ID NO: 2293 - DNA, 71 bp, Arabidopsis thaliana
tttaactgcttcctctccttcaacaggtgctccgccgccgccaccacctttcttgatggagagtttgttac

SEQ ID NO: 2294 - DNA, 68 bp, Arabidopsis thaliana
tcgatcggagccctggattgaggagaggaaggaccggctacagcggcggcggcggcgatcggctctga

SEQ ID NO: 2295 - DNA, 134 bp, Arabidopsis thaliana
aaattacgagtttatgataatgttattatcatgatgatatctatcatgactatggtatgttgatatgatgatgaagaagatagtatgatgatgatggtgatggtagtataatattatgagagggtaatgatgat

SEQ ID NO: 2296 - DNA, 134 bp, Arabidopsis thaliana
gtgttcattgtgagcttggactttggagagtatggtttggctatggagtggatggagaaatgtttgtatatttataggcgcagatccataactcataaccagcttttcacacttttttttgttcttcacatttt

SEQ ID NO: 2297 - DNA, 129 bp, Arabidopsis thaliana
tgcagtttttatatgtgctgactcataaactttccttgtaggttttgaataaagctcgtgatgatgctggaagtagtgctcaaaagagtttagcagaaaccaataaccttaaggccatggtgacagcag

SEQ ID NO: 2298 - DNA, 109 bp, Arabidopsis thaliana
ccaggatacaagtttccgttgttgatacttgagtcatgatttgcagctagattctcgtaattatcatcttcatcaacatcattttcatctggattcttgaaaccattac

SEQ ID NO: 2299 - DNA, 74 bp, Arabidopsis thaliana
gaatcatcatcgtcttctgcttctgattcaaatgtggataatacagagattggggagaagaagaagaagagaaa

SEQ ID NO: 2300 - DNA, 81 bp, Arabidopsis thaliana
atataacaaaaatacgaagaaccaggtgattccagattcattgaacctggacacattggtttgtttttggtgactgcgaat

SEQ ID NO: 2301 - DNA, 91 bp, Arabidopsis thaliana
aaatgttcttcatctgagccggaaaacggtgaggattcggcaccgtcgctgtcttcctcctcctcatcgtctacaagtgaagtatctacta

SEQ ID NO: 2302 - DNA, 134 bp, Arabidopsis thaliana
tcttaccctatgtttcaattgtcatctttgttttgggtctaagattgggctttagttagatatatgttgttgggctccaattcacctttatgtaaaaaaaactagttgacgacaaaaaaaaaaagtgatgagaa

SEQ ID NO: 2303 - DNA, 89 bp, Arabidopsis thaliana
ttcgggatttcgccagtgaggttgttgtgtgaaaggtctaagctctctaccttctcaagatctccaaaactttgtgggatcaatccaga

SEQ ID NO: 2304 - DNA, 86 bp, Arabidopsis thaliana
gcgagtgaagtacatcggtgtggttgtgatcttagatcttggtttttgaacgatctcatgcaaccaaagtggtaaagcttcacttc

SEQ ID NO: 2305 - DNA, 126 bp, Arabidopsis thaliana
ttcattgtagatctaattagggtttgtcattttcgtttgattttcattgtagatctgattagggttttgtgtttccaaatcgatttactaatgttttcttttttattgcaagatgtctttctctgg

SEQ ID NO: 2306 - DNA, 83 bp, Arabidopsis thaliana
acctgaagacccaccatttgttgatgggcttggtgcttcaacagagtaatgaagctcaggtggtgttgggttttctttatgaa

SEQ ID NO: 2307 - DNA, 354 bp, Arabidopsis thaliana
gtatcttcagttcttcaatttcagctacttggtatcagcttcgtcattgtatatcaacacattcttaatatataatactactttttcatccattaaaccccttacaatgtcgagtaaacgaagcatctgtcccctggtattgtcttcgagcttggtgtttttttctagccaactccaagttctcgagttgatcattgtttgtattcttgagacattatttggggacgagatgttttgttgactcgatataagaaggggctttatggaagaaattgtagtattatatatcgagagtggctctctaaaccatgttcttcctcgtgctgaccacttagctattattgaagcgtttgt

SEQ ID NO: 2308 - DNA, 97 bp, Arabidopsis thaliana
gagaaagaaagtgacatgggagagattttgttgaagatggctcaagatttaacttccatttcataccaagaaagcttccatggagctttcacatccg

SEQ ID NO: 2309 - DNA, 103 bp, Arabidopsis thaliana
agtttaattccctgatgcacattttgaattcggtttgcgtattggtcttcgagttttccgtcggcggccatggacgcgttcaaggaggagatagaaatcggga

SEQ ID NO: 2310 - DNA, 96 bp, Arabidopsis thaliana
gagctttgcaagttgggtttttcgaagaggcttaaatggtggcagctggtcatactcatcatcttccccatcttcctgctcagaatcagacacatc

SEQ ID NO: 2311 - DNA, 97 bp, Arabidopsis thaliana
aggagccgttggtggcgctgttggcggaggtggaggcggcagtgttggtggaggaggacgtggtagtggcggagctagtggtggagctagtggcgga

SEQ ID NO: 2312 - DNA, 133 bp, Arabidopsis thaliana
agtgttggagcgggaggcggtgttggtggtggtgtaggaggtggagtcggcggaggtgtgggtggtgctgttggaggagccgttggtggcgctgttggaggaggtggaggcggcagtgttggtggagggggac

SEQ ID NO: 2313 - DNA, 104 bp, Arabidopsis thaliana
ttggtggaggagggggtataggaggcggtgctgggggtggtgtaggaggtggagtcggcggaggtgttggtggtggtgttagaggagccgttggtggtgcagtt

SEQ ID NO: 2314 - DNA, 102 bp, Arabidopsis thaliana
tgggattcgaattagatagtgaatgataatgatgatgatgcataatgatttcatggttagtacatccttaatcactatatgcatcgcatggcccgcgattct

SEQ ID NO: 2315 - DNA, 94 bp, Arabidopsis thaliana
aagtgattggagaaactgatttggttctgttgttgtaaaagggtgttctatgcattgaagcatttgcagaaatggtatcttctcttccatagta

SEQ ID NO: 2316 - DNA, 106 bp, Arabidopsis thaliana
aaacactatctccaatattatctgctcattgaatttgaatgtttatgcatcttaatcaactatagattataaataagagttcagtaagtgtaagattaatacctta

SEQ ID NO: 2317 - DNA, 107 bp, Arabidopsis thaliana
ggtttcgtgagttcatatctcttgttgatcttaagaaaaatggtttccttattggagattgttgtatgtttggtgtcaagttccatgggattgaacctgctaaaccc

SEQ ID NO: 2318 - DNA, 123 bp, Arabidopsis thaliana
gtaactaagctactgatgccgtaatgacttgtgatgtgtgtcgacgtacgtgttgctggagatgaagatgatgtgcttggcgtgtattttcagtttatgggcataacaagacaatctacaaga

SEQ ID NO: 2319 - DNA, 130 bp, Arabidopsis thaliana
caaatctgcctggtgaatttgatgaagcactgttgctgtgagactctatccgatagttttttttttagtttggatttctagaaactgtgtaaatgtgtttgatcatgttggagtgacatgtcttgatttg

SEQ ID NO: 2320 - DNA, 83 bp, Arabidopsis thaliana
tatgggggaaggtttgattttggggaacaagtatgggttttggagtacttctaggaaaactcgtgttgttgttgagcctgtga

SEQ ID NO: 2321 - DNA, 109 bp, Arabidopsis thaliana
gggagtcatcatcactcttgtgtttttgtttaccagaactggttgctgttattgtaaaagtcttcttcttcttctaaagttgacattggactctttctgattctccttt

SEQ ID NO: 2322 - DNA, 180 bp, Arabidopsis thaliana
aagaggctatttctgttgtggggaatgttgtttggatcgaggatatcataaacgcatacacatgtttatatgttatgatgcattatatgactgatgtaatgtacatatatatacatacatgccacatggtatcgtcggaccaggcttcatccccctcaacatgttaattgccttcaatca

SEQ ID NO: 2323 - DNA, 87 bp, Arabidopsis thaliana
ctcagccaatgagacttgagggtgttaagatcggttccacgaatttaggttactttgatgttgatgctgacaatgtcatcagccgga

SEQ ID NO: 2324 - DNA, 121 bp, Arabidopsis thaliana
ctacgtgtgtgtgtgtgtgtgttgtgcaggctaattcagcgtctgggatgcatgtgaatgatgaatgcaagattaagttcttagagttgaaagcaaagaggacttacaggttcattgtgtt

SEQ ID NO: 2325 - DNA, 147 bp, Arabidopsis thaliana
ttcgaagccattgttgttgttgctgctgttgctgttggtattgatgcggctgagacggcgcttgttgaaactgttgttggtgattctgagcgtaattaccgcgttgaacgtattggggcggcggatgttgttgataacccgaccgtg

SEQ ID NO: 2326 - DNA, 90 bp, Arabidopsis thaliana
gaagttaaccctaaaaccaatagagccactggatttgtgaagaagcctggtgttcttgttggtgatcttaagaggttagccattttaaaa

SEQ ID NO: 2327 - DNA, 91 bp, Arabidopsis thaliana
attatttatatacgtgtgtgtttctctgtgtgctagctaaattaaatgagattagttgagaacctaaaggcacagaaaaatatggatggga

SEQ ID NO: 2328 - DNA, 110 bp, Arabidopsis thaliana
tctcagcgttatatcattaccacatttgttgagattacttgaaattcgaaatcaagtttctatatttatgaagctatgtggttggatgatgaactctcttttaaagtttt

SEQ ID NO: 2329 - DNA, 71 bp, Arabidopsis thaliana
aacgagtaagaggcaagctcaatggttttgatatgaagaagatgcataagaccattgggttccattcttct

SEQ ID NO: 2330 - DNA, 120 bp, Arabidopsis thaliana
tcagatgttgattgttttccaaggtgtttgtgtgagaaatgacatctctctctctcacccattcaggcggtggaaaaattcaataacacttttaaaaaagatttttgttcaataggtttt

SEQ ID NO: 2331 - DNA, 81 bp, Arabidopsis thaliana
ctcgtcgtcgtcgtcgtctccacttcgatttttcaatcagtaatattggtggttcagagatgatgatgatgaatcttttaa

SEQ ID NO: 2332 - DNA, 126 bp, Arabidopsis thaliana
acccatgtcaactactacatggtaaaaattatgatccattcgagttaaccatatatgcaaaaatgattgtcaaaattctcaaaatggttctttaatcttgtagtaccacggagggactaactttgg

SEQ ID NO: 2333 - DNA, 134 bp, Arabidopsis thaliana
ttagtcatttctcacaacgctaagcttatccgagatgatctttgtagataatactttattttgttgtcgttgttgtaaatttatactcctactaaagtcatatgtttgtttttcttagaaggtggagaaaatgc

SEQ ID NO: 2334 - DNA, 89 bp, Arabidopsis thaliana
atgcaatgtaggtaaagtaattaatgtgtcagagagtgagagaaagagcgaaccagctgttccattttccggtgcagaagctgatccaa

SEQ ID NO: 2335 - DNA, 67 bp, Arabidopsis thaliana
gctttgacaggaaggagttgccatcgaaattgctgaagctgttgttggagctctgaatggagagctt

SEQ ID NO: 2336 - DNA, 83 bp, Arabidopsis thaliana
tcttcatcttcgtcatcatcaacgtacctcgatcctgtcgccgtcgaaactgcaggatccatgtttgagaaaggattgggtga

SEQ ID NO: 2337 - DNA, 114 bp, Arabidopsis thaliana
tgtggaggattgggaattgagagattcagaagacgcttttgaggaagatgatgatgccgattattcttcttcttcgagttctctagcaacttttaactctcctcctaccatacc

SEQ ID NO: 2338 - DNA, 100 bp, Arabidopsis thaliana
tggtgggatttcaaccgggtggaagaaatttgtacaagacaacaacttgcgcgaaggtgatgtctgtgtgtttgagccagccaattctgaaacaaaaccg

SEQ ID NO: 2339 - DNA, 135 bp, Arabidopsis thaliana
attgaaagatgacggttagttaatagggttcatattctgtgtgattttcaggcagtattttgttgatgaggatgatacagtccaggaaaaggtgaaactcactgacgctttcctttcttacatttgttctcttcg

SEQ ID NO: 2340 - DNA, 103 bp, Arabidopsis thaliana
aaaatctatattctgataagttgaagtctcaggtttatggtgaggattggagtgatgttgattcttgcttctctgagtatgtttcttgttagtacaaccttca

SEQ ID NO: 2341 - DNA, 136 bp, Arabidopsis thaliana
taacaaactttctttcccgattgcgggtccatcatgaaacacatagattctctaattgctttgctgttgttgatgtagtgatcacaatcgacattaagaaggtaaggagcgtttgatagaacagcagagactcgga

SEQ ID NO: 2342 - DNA, 83 bp, Arabidopsis thaliana
atgcgcttggctcacggaggtgatgaagaagacgatggtgggatcaaccagttgttccttcatgttgctgtatcaaagccaaa

SEQ ID NO: 2343 - DNA, 83 bp, Arabidopsis thaliana
acaggaggagcaggagcaggaggagcttcaatctctttcctctcaggacttttggccctcttggctctgtctctcacaaactc

SEQ ID NO: 2344 - DNA, 91 bp, Arabidopsis thaliana
cccattcgtctccaaagagattacagttttgagcatttctcatctctcgaagctcttctctgtgtgtgtggcgatggctgctaattcgata

SEQ ID NO: 2345 - DNA, 135 bp, Arabidopsis thaliana
aaacgtaagtggcatgtccctgagtaatgtattgagcttgtacatatatgtcctggtttgctgcttgttcatgattttggagattttatgttcgtgtgtttaatcgatttgttttaccccaggtatgagcctaac

SEQ ID NO: 2346 - DNA, 139 bp, Arabidopsis thaliana
tcttgaagagagtgagagacagagagagataaggttttttgtttccttctttaacagattcttcctctcttctcctctcctcttattaatctaatcctcctccccgaatatttctctgcctttagttctttcttttttg

SEQ ID NO: 2347 - DNA, 97 bp, Arabidopsis thaliana
atagaaactgacagaagagagtgagcacacaaaggcactttgcatgttcgatgcatttgcttctcttgcgtgctcactgctctatctgtcagattcc

SEQ ID NO: 2348 - DNA, 94 bp, Arabidopsis thaliana
cgaggcttaaaaaatgtgttcttgatggttgctggttgttgtgctataggtattatgggggttgggctgccaccaatatttactttttgggttt

SEQ ID NO: 2349 - DNA, 90 bp, Arabidopsis thaliana
tgacgacgtaagcagcaataccaaatgaagaagaagatggattgatcggcgatttatttttgattttatttttaattgtttccgcgtttt

SEQ ID NO: 2350 - DNA, 84 bp, Arabidopsis thaliana
cggacgcagtttctcacagatacgtacatcttctagctccggcgactacgacagtgatgatgatgatgatgaagcaggggacga

SEQ ID NO: 2351 - DNA, 132 bp, Arabidopsis thaliana
gactcgacaagtgcatttcaatatacgttgaagtgaggagcttgaatgttagagctagtcttcaagcacttgacttagattatctagatatctcggtttctgagttcaacgatgtgcagagcatagaagggt

SEQ ID NO: 2352 - DNA, 132 bp, Arabidopsis thaliana
caggctgcatttgcagtggtgaacagaggagtccgtccaacagtcccagcagattgtcttcctgtgcttggagagatcatgacacgttgctgggatgcggaccctgaagtccgtccttgttttgcagagatt

SEQ ID NO: 2353 - DNA, 94 bp, Arabidopsis thaliana
aagaaaaggtttgttaccgaacttatgacttcagattgttgtttgttttgtctttgagagtgtgaattcatggttctgtgattgcttcttatca

SEQ ID NO: 2354 - DNA, 142 bp, Arabidopsis thaliana
tcagaataaattagtatttagtaagtaagtagcacataaatcttgttttcacaatttccatataaatgtgtatatgcatatacccggcgagaaatgagatgaggaaggtgattgcagggatgatgttacccactgcacttcc

SEQ ID NO: 2355 - DNA, 121 bp, Arabidopsis thaliana
atgagtttgagagagaaaaggaaaaggaacaggaagactcaagctttgttgttgttggtttcagacatggaagctctcagaacagagagagaaagattgctctgtttttttaatttcaaga

SEQ ID NO: 2356 - DNA, 107 bp, Arabidopsis thaliana
gatgaactcaagactaacacagttatagctgtcaaagctggtgaaaccataccaattgatggagttgttgttgatggaaactgtgaagttgatgagaaaactttgac

SEQ ID NO: 2357 - DNA, 121 bp, Arabidopsis thaliana
tgattgaccagaggaagttagctttgttcatctagattaggctattattgaggtgttgttgtggctctgaagcaataaaggatttgatgagatgaaggcagttaaaagatggagtataggg

SEQ ID NO: 2358 - DNA, 97 bp, Arabidopsis thaliana
gacgagatgagagatggctatggatggcgtgttgaagtttgaaggatgaaccattttgaaattgcatggagtgtttgtgaagttttttatctcgtga

SEQ ID NO: 2359 - DNA, 101 bp, Arabidopsis thaliana
attacatggacaaaaggatcacatgatgacaatgatgatgatggacttgagtacatcaccaccatcatcaccactttcaccatccttatcgccaaagtcac

SEQ ID NO: 2360 - DNA, 85 bp, Arabidopsis thaliana
attgatgtgttgtgtctgtgtgcttattgtgtaagcacttttaaaatcgtgtttaggtcattcgtatacgcaaacaatacgttag

SEQ ID NO: 2361 - DNA, 112 bp, Arabidopsis thaliana
ctttgttccaatattagaaaaatcaaacatcagatatgatgttgatgttgttaggtgcatttcttattttattcattgataatttcatatcttgatttatatattgttttat

SEQ ID NO: 2362 - DNA, 91 bp, Arabidopsis thaliana
atattcaagtccagcatacgtatatatattttcgatttttgaaattgcaaacttagttataaataaaatgtgctgtgtgcatgttgaatgt

SEQ ID NO: 2363 - DNA, 139 bp, Arabidopsis thaliana
ctgtgatctcttcttgcttcgataacgatttgttcgttctaggagtgactgatttgtaattttgatttgcttgattgattcacactgtagtttgttcgatctatcgttatggaatataggatttggggttttaggcttt

SEQ ID NO: 2364 - DNA, 100 bp, Arabidopsis thaliana
ggaagcggggcattttcttctccgttgccgcttccgctaccacgaagaatgggtggtggaggaagagatggtggtgtattggaggagggtctctgtgttt

SEQ ID NO: 2365 - DNA, 109 bp, Arabidopsis thaliana
gtggtgattgaaggaaggaaagtgacgaaagagatcgctggttttgtgtttagggttcttcttaaagaaggaaactttgtggctcttctttgtgctcttcttgcttact

SEQ ID NO: 2366 - DNA, 131 bp, Arabidopsis thaliana
actgcaacatgttacaggattccatttccttttctacctgatagaaaagcaagcaatctctgctttctctgctttatggaaggtcgtttaggaactttagctgcagtagcatttgcatgtaactctgctaa

SEQ ID NO: 2367 - DNA, 137 bp, Arabidopsis thaliana
aaaaaaaccggtcactcagcattcaaagaaaaaaagttatcttcatcatcatagagaacaatatatatacatgtttacgtgtacatatggatacctttgggagaacttgaaaggaacttgaaggtagggatccagag

SEQ ID NO: 2368 - DNA, 116 bp, Arabidopsis thaliana
ccggcatttcaagcctccgtccgatgcggcgggttatgagaccctcaatggattgagtctggttttgtttcttatgagcgaggaggatgaggaagatgatggtggcggttagtatc

SEQ ID NO: 2369 - DNA, 97 bp, Arabidopsis thaliana
tttgtgattcttgatgtaagaccagaggcagagtacaaggcggtgagtgatactatgctctctctctcgtcgtgtcatgatcgcttgtaattttaat

SEQ ID NO: 2370 - DNA, 102 bp, Arabidopsis thaliana
aaaagatgaaatgtggattataatcgaatggtgtttttgttggcacagagggataataacagatgtattaggcggagatattcagtttgatttctatcatcg

SEQ ID NO: 2371 - DNA, 114 bp, Arabidopsis thaliana
ttttcgtaacattgtaaactattcgattgttgtggtgattgtgatgatcttgatgtgaaggaattagatttaatggtagatttcagctcttgtttatgtgatttcaatgtaagt

SEQ ID NO: 2372 - DNA, 75 bp, Arabidopsis thaliana
acgatgatgatgatgaagatcatgaggctaagattgctgctgctgcttccgatcatcatgaacacatcaaaggtt

SEQ ID NO: 2373 - DNA, 68 bp, Arabidopsis thaliana
gaaacagggtgattcagagcttatctatactcccacatgggtgtgtatttgttctgtttgactcttaa

SEQ ID NO: 2374 - DNA, 99 bp, Arabidopsis thaliana
atagttggatggaaaacgcggattcatgcatgtgatttggacaaaatgcgtgtctaagattgagtgagtgtgtgtgtattcatttaaccgcaagattaa

SEQ ID NO: 2375 - DNA, 84 bp, Arabidopsis thaliana
ttcgattcgattctcttatcttcttgatctctgtttgttcatctgtggtggatctccagatgttggttttgagaattttgtcgc

SEQ ID NO: 2376 - DNA, 68 bp, Arabidopsis thaliana
agtctctgagtatctatcttttgtggacaatggcaacttctctgttgatggtgtgctctctgattttc

SEQ ID NO: 2377 - DNA, 112 bp, Arabidopsis thaliana
gttcttgtcagaactgtttgatgatatgtatcctgttaactctgcttctgcttctcaagattcttagaaccgagtgttattgctaaaatatctcagctttcgcaatttctga

SEQ ID NO: 2378 - DNA, 94 bp, Arabidopsis thaliana
actaacagttaccgggaacattgttttgcagtttcgtttcagctatatgatcttaagcagcaaggtttcatagagaggcaagaggtgaagcaaa

SEQ ID NO: 2379 - DNA, 117 bp, Arabidopsis thaliana
ggaggacagagtttggtgtggataatgatgaggtcaatgtatctgatgatgttgatggaaatgacagcgtcgatattgatcgacatcatcatcgtcgtcatcgccacaggcaacaag

SEQ ID NO: 2380 - DNA, 130 bp, Arabidopsis thaliana
tcacagcttgaaagaagaattgaagagagtgaatgatgaaaacaaaagcaaagaacatgtgagcttttagattgaagagtttttagtacttgtcaattctttgtagagtttccttgtgctttgaaactga

SEQ ID NO: 2381 - DNA, 137 bp, Arabidopsis thaliana
gagagaacagatgcttgatgatgcatataacaaacacatgtttgtagatgaaggtttaccaaaatggtttgtggatgacgagaagcagcacagacaaccaatgaaacctgttacgaaagatgaagttaatgcaatga

SEQ ID NO: 2382 - DNA, 133 bp, Arabidopsis thaliana
tgtcgtcgttggtcttgagctatgaggagcgttaataatagtagtgtcgacaccgtgaacgccgccgcttccgccatcgtctccgctgagtctagaacacaaccgtcgtcggttcaggtacttctatgagctc

SEQ ID NO: 2383 - DNA, 109 bp, Arabidopsis thaliana
gtttttcacttcgggtgtagttgggtttgatctcttatcttctttgtctgtgtttccattgactgttgaggtttttcttccctgactgctcactggtctccatattttt

SEQ ID NO: 2384 - DNA, 78 bp, Arabidopsis thaliana
attggttcttgatggctctgctgcttcaatgcaacacttacctcagcagcagcagcagcaactactacaacagcaaac

SEQ ID NO: 2385 - DNA, 78 bp, Arabidopsis thaliana
atatatcttctgaaaaaggaaggttgttgtttgaagatgctttaaaactattgatgcggcttggaactcggcctcctc

SEQ ID NO: 2386 - DNA, 128 bp, Arabidopsis thaliana
ataaggacgtacattaggagaaatctgttgggttccttgttgctgtaactgctgtctcagctgctgctgtttctgaagttggagtctctgagagggtgacatggattgaagcatctgctgatgttgcc

SEQ ID NO: 2387 - DNA, 127 bp, Arabidopsis thaliana
ctttttacctttttcatatctgtttttcttttccatgttctattttgtctagtgtagatgtgcattttgcttatcctctacgacccgacgtgaaagttcttgatgggctgagtttgacgttgaattc

SEQ ID NO: 2388 - DNA, 115 bp, Arabidopsis thaliana
gacagacagttgtagcacattgtagggtatgttgttgagttgcatgccgtttttacgtacgttgtgtggttttggtacgtgcctggtggggtggctgctgtctttggaaagtttg

SEQ ID NO: 2389 - DNA, 90 bp, Arabidopsis thaliana
gacagtccttggttgaacttgtgagagatacatacacagtagttggtaacttggtattttgcagattcttcttccacggacgtctgttta

SEQ ID NO: 2390 - DNA, 89 bp, Arabidopsis thaliana
gctggaaggcgagtgggaagagggcgtcaccggcgagaatggccatgccagagccgtagacagtgtggttagatggctttcctctgcgc

SEQ ID NO: 2391 - DNA, 97 bp, Arabidopsis thaliana
agcgtggtattacagtttcgcttgcattctaaacattgtgtctttttccaaacagagttgatgttgctgtgcagaaggagcttcacacacatgaatc

SEQ ID NO: 2392 - DNA, 75 bp, Arabidopsis thaliana
aggaaaggatggcactaaaagaagatggagaagaactaggttcatctttgctcttctttgggtgtagaaatcgac

SEQ ID NO: 2393 - DNA, 140 bp, Arabidopsis thaliana
aacaatgtaagcactaaaactttgagattttttcttcatgtctcaattttgatttcttatgtgatgttgatgttgctttgcagctgggaaacttccaaagaacatttataatgtatcatggaggcatgattcttgtctac

SEQ ID NO: 2394 - DNA, 64 bp, Arabidopsis thaliana
attggtgagatgattccacatgctttcttgaacgaggacggctcttgtgtgtgtgtctctcaca

SEQ ID NO: 2395 - DNA, 83 bp, Arabidopsis thaliana
ttcttttggttctaattatatatagacgaactagtaaagtttcgtttttgcagtgtctgtgtgtgatggagtccagtagagta

SEQ ID NO: 2396 - DNA, 95 bp, Arabidopsis thaliana
taataataaagctctcaaatgtgtgtgtgtatggtagattaatgtggaggaagggtccatggtggttcatgcataccagtgacaaggtgagagag

SEQ ID NO: 2397 - DNA, 132 bp, Arabidopsis thaliana
gacaaataattatgatcctgtgagtctctgagttgaaatagaccttggtgagttaagtgtgagtgagagagagttattaccttgatcagattatcagttttctccttcttcttaagcatttgaagagcttct

SEQ ID NO: 2398 - DNA, 72 bp, Arabidopsis thaliana
atgttcttcttcttcgtcgtcactggaggaatcagtagcgtctgggtcagtgactgagatacgaagaatcct

SEQ ID NO: 2399 - DNA, 85 bp, Arabidopsis thaliana
ctttctccttctcactaagtgtccggtggtgaggaagatgatctcgaccttctagatgacggacgcgtgcagaagaagaaagagc

SEQ ID NO: 2400 - DNA, 83 bp, Arabidopsis thaliana
aagatgcataaaggtaaatggagagaggcagacatatgtatgaataatggatggagtctgtcgtcatcatcatcttattgtgt

SEQ ID NO: 2401 - DNA, 178 bp, Arabidopsis thaliana
ctatatataagcagataagggattgcacgatttctcaatagttccgtcgctgcgtttccatcacgtcgattgctgtcagagccacgcctatgaagaatttgtgcggctctgataccaattgatgctatggaaacatcgatattgcctgattccgtgtttccttttaccttgttgttaa

SEQ ID NO: 2402 - DNA, 218 bp, Arabidopsis thaliana
tctaccaatatatatatacatacagagctttccactaattagggttctacaattccatcagtcggtttccatcacgtcaattgctatcagagcaacgcatgatgtataataactaagcgtcgctctgataccaaattgatgcaatggaaacatcgattttgcttttagatttattttccccaatttctcgtagtcagttctttaaatgcttcagtttc

SEQ ID NO: 2403 - DNA, 73 bp, Arabidopsis thaliana
ggagtaggaagcgttgcgggaagaaagagaagccaaaagggtcttgagattgttgttgtaagtgctgttactt

SEQ ID NO: 2404 - DNA, 91 bp, Arabidopsis thaliana
aaacaaaaggaattcaagaatgagattcttgttgtagcaaagcttaacgcagaatttcggtcaagcttcgatttttcttagttaaattact

SEQ ID NO: 2405 - DNA, 92 bp, Arabidopsis thaliana
ggagatggctttagttgttgttgatgctgtggcggccatctttagggctgtggcaatgagtcagcagttagatgataagcggtatcggaaag

SEQ ID NO: 2406 - DNA, 136 bp, Arabidopsis thaliana
cttaatgatactctaaaggtttagcttattaatttcaatatttcgatttgagcgtgtccatgtgcatctatatatacttgtctctttatatgtatattggcgtagccatgtaaaatattgatgcatgatttgaatc

SEQ ID NO: 2407 - DNA, 109 bp, Arabidopsis thaliana
tatttaaggtttcgcagtgacccttttcttcaaatttggtttttgattctgcatgttctcagtatcactcttttggtggtgtccctgttttgacttttgtgtttctcta

SEQ ID NO: 2408 - DNA, 116 bp, Arabidopsis thaliana
acttttgacaatttgttctttggtgattcttgcctttgcatgtgcttgctttgatttgtcttgttggcaacgtaagtgaatgggtatacgcttttaactttttcattgtcatcttt

SEQ ID NO: 2409 - DNA, 154 bp, Arabidopsis thaliana
gaaataaggagaatcattttcgtcttctacttagttttcttcaactcgatttctctgctccatcttcttcctcgtcttctcattctctctcgctctggcacagtagaaactgagctcacgaaagcaggtttcacgtctcttccttatttacctc

SEQ ID NO: 2410 - DNA, 127 bp, Arabidopsis thaliana
ttcacaggtagtcagtgtttttgtttcgaactcttccaacatgcagaaggaaattgctggtgatgctccatcagcaccaaccactcgtgttcggcatcggaagcgaaacagcgatgtatgtttgcca

SEQ ID NO: 2411 - DNA, 77 bp, Arabidopsis thaliana
aacttgaatcacttcaaagatcacaaagcttcaatttttaacaaaatttggttgcttctttgtgtgattaacaggtt

SEQ ID NO: 2412 - DNA, 82 bp, Arabidopsis thaliana
tggctgctgcgggtaacgaagggcctggtgctcacactgttgacaatgttgctccttggcttttgactgttgctgcaactac

SEQ ID NO: 2413 - DNA, 129 bp, Arabidopsis thaliana
ttgacaaattcggccaagtagactactagttagtttttctcacctgtgaaatatgaattttgtttttatgtattgtgtgagactgtgagctgtgtttgtttatattggtccagtacatatatcaacttt

SEQ ID NO: 2414 - DNA, 304 bp, Arabidopsis thaliana
acaagacaagaaaagaaaggtagagaaaacatgataatgatgattacgatgatgagagtctctagttgtatcagagggtcttgcatggaagaatagagaatgaggttgagccaaggatgacttgccgggtttttttaccaatgaatctaattaactgattctggtgtccggcaagttgaccttggctctgtttccttctcttcttttggatgtcagactccaagatatctatcatcatgaatcgtgatcaaactttgtaatttcattgaaatgtgtttttcttgatgcgaattttttggcttac

SEQ ID NO: 2415 - DNA, 134 bp, Arabidopsis thaliana
cagaagtgcaaaaatcataggttcgagtattggagtgagcgttttgcttcttttaagtttcattatcttcttcttgtggaaaaggaagcagaagcgatcaatactaatcgaaacacctattggtatatctgtaa

SEQ ID NO: 2416 - DNA, 93 bp, Arabidopsis thaliana
cattgaagtcaatagactcatcgttccatgaattaaggacaaaccctgtagggtcatgtttgatgcctttcttgaattcaagcaatgccatga

SEQ ID NO: 2417 - DNA, 96 bp, Arabidopsis thaliana
tcttattgtttagtagacttcttaacactgtttatgtgaaaaagtacaatactattcatgttgcagctaggaattcagtctcaggatgatgatgat

SEQ ID NO: 2418 - DNA, 106 bp, Arabidopsis thaliana
gaacaagtgatcatgtggcggcgatgccgatgacggagaggaggagaccaccgtattcttgttcttcgtcgtcggagagacgtgatccgtttcacattgttcataa

SEQ ID NO: 2419 - DNA, 101 bp, Arabidopsis thaliana
aagaagaagaagagactggaccaaaagaggatctaacgaaagtgattggtttgatagtgattgttcttgttggattgctgtgtgggaaagtctttgctatt

SEQ ID NO: 2420 - DNA, 102 bp, Arabidopsis thaliana
tcctgagtcttcaaaacttcccaagggagagtataaacttcagctgtatctgaggtttgtgctacatctttgatggttgctgattgttttagaatttaaaca

SEQ ID NO: 2421 - DNA, 129 bp, Arabidopsis thaliana
taagcgcctttttgtatctcttgtttgtttatagttttccttgtggttgaagcaatggttttgattgttgaagttctatgtctgtttcaaattgatgtatggagttctatttttggtgtgactgaatct

SEQ ID NO: 2422 - DNA, 115 bp, Arabidopsis thaliana
gagaatgaacatgttctttcccatgcttcttccctattgctgctgatgctgctgcgagtttcgggctgcgagagcagagcacaagtggggaactgacgaatgtgagaaagattag

SEQ ID NO: 2423 - DNA, 80 bp, Arabidopsis thaliana
ttgtggtcggcagtgttgttggagatgttcttgatcctttcacgaggttggtctctcttaaggtcacttatggccataga

SEQ ID NO: 2424 - DNA, 127 bp, Arabidopsis thaliana
aattgttacctgttatcaccatatcatccacatagagtaatagaagaatgacatctttgttcttgatgtagatgaatagtgatggatcaggataactgcaagtgaacccgaactctagtaagaatgt

SEQ ID NO: 2425 - DNA, 91 bp, Arabidopsis thaliana
ctaaaatgaatctcaaaaatgttgtgaagaaagatccaaacctgaacagagtagtagactttgttcttcttcttcaagaacttttggaatt

SEQ ID NO: 2426 - DNA, 131 bp, Arabidopsis thaliana
tcatgcacattaacattcgttaaatataataaactaaaaggccatataattgtacatgaacatgtttgttgttgatacgacaaatccattttcaggataatccacatatattattaccaaaaacgaatgct

SEQ ID NO: 2427 - DNA, 149 bp, Arabidopsis thaliana
ccaaaatggtaaagtcctcttgttcagtttctaatgtattacaggcacgtgtgtgtgatttgtgagcgtgtgtgagtttggtttgtgcaggttgggaaggtgatatacccgattggttacggagctgaccctacaggtggacaagacag

SEQ ID NO: 2428 - DNA, 125 bp, Arabidopsis thaliana
gatcagaatcctttccttagatatgcccccattcacattgcattttacccagtctgtgagaggtggttttcatattggaggattttgtggccttgtagattataaaaacaacaatatcaattcaa

SEQ ID NO: 2429 - DNA, 126 bp, Arabidopsis thaliana
aggagttcccatcaacactgcttgagactctctctgaagttgttctattagatttggagaactgcaagaagcttcagggtctgccaacgggaatgagtaaattggaatttcttgtcatgctcaaac

SEQ ID NO: 2430 - DNA, 100 bp, Arabidopsis thaliana
gtttttaactttttatacgaatccagagagaaagagagagactgtgtactactcggtgctctgcttctctcattttgtagtgaagtgaagaaccctaaaa

SEQ ID NO: 2431 - DNA, 117 bp, Arabidopsis thaliana
atggaggaggactaccgagacaacatgttggaagctactgagagtcataatcatcatcatctgatgatgctctcactctttttttttgtagacttttgttttggtagaattaactaa

SEQ ID NO: 2432 - DNA, 125 bp, Arabidopsis thaliana
aaaactgcttatacatacccatttgttgattatatcattagcgagtctcctattaggtgtagtttcttcatctgattttgataagaacattatgaccttcccgagaccgctcttgatcaactgtt

SEQ ID NO: 2433 - DNA, 108 bp, Arabidopsis thaliana
acttccacctttcctcaccaaaacatatgagatggttgatgattcttcatccgattctatcgtctcttggagtcagagcaataagagtttcatcgtttggaatccgcc

SEQ ID NO: 2434 - DNA, 81 bp, Arabidopsis thaliana
acctgtcttcttcagcagtccattgtcctttgactaaggttgactttttggtttctttccatgatgatgatgaagaagaag

SEQ ID NO: 2435 - DNA, 84 bp, Arabidopsis thaliana
aaaggatgtgaagatgaggagccatgatgatgatgatgatcaaactgatgatcatgatcaagatggtgaaaatcttgaagaaag

SEQ ID NO: 2436 - DNA, 140 bp, Arabidopsis thaliana
tcccattttacccttcttcttccttcaaatccactgatgtcttgttatgtgaagtaatgaagacgaagatgatgatgaagaacacgtctctgatctttgttcttctttttatcaccttcttcttcacaagtatctcttac

SEQ ID NO: 2437 - DNA, 85 bp, Arabidopsis thaliana
gtctgtacccatttcttcctgttgatgttctatcttgtctgaacataaatgagatgagatgcttggtgaagtctgttctatcttc

SEQ ID NO: 2438 - DNA, 83 bp, Arabidopsis thaliana
tttgtttttgttattgcaggcttgtggttaaaaatcatttcagacacagtgcttttgatgactctctgcaacaaacaacagca

SEQ ID NO: 2439 - DNA, 79 bp, Arabidopsis thaliana
taccaaaatttagtttaattttgcatgaaagtgatcacgagacagattttctcgtgtgaatgattttgttggaagtaaa

SEQ ID NO: 2440 - DNA, 75 bp, Arabidopsis thaliana
acttgactgtcagctttgatgtgtgttctcgccgacaagaagatgagaaaacccgttgaatttgatgctcgagct

SEQ ID NO: 2441 - DNA, 124 bp, Arabidopsis thaliana
cgtaaatgtttcaaaactcaaattggtggaagtgggaaagttttagattcttcttatacatacatgtgaaagggtttctgagttttattgcttttttttaactgtaaaatcactaattgatctt

SEQ ID NO: 2442 - DNA, 116 bp, Arabidopsis thaliana
gtctagagcttgcgaagtattcctgattggaatctgacactcatcatcatcgtgatccaaattgatcggaggagaaggaacggactgggattcgtcagaggaagaagagctatacc

SEQ ID NO: 2443 - DNA, 114 bp, Arabidopsis thaliana
gggagggacaaatgtatgaatagcgagacaaatgtgttgtgttctctatttcttctgtcacacaagaaaagacaacatcctacaacgcatcgcatgcattgtctttcaaacccg

SEQ ID NO: 2444 - DNA, 110 bp, Arabidopsis thaliana
tttgatctctttttttcttactttatccatctctgtctctgtgtgcgtgcatatctaggttatagccttatatacacacacgtgaatgcctgaatggaacaagtctaaac

SEQ ID NO: 2445 - DNA, 134 bp, Arabidopsis thaliana
atgagtcactgaaacagtgtggctatttgttatctggagttcgtggtaatgtagataaatgtttgtatgctgtggatgaagattgtagaaccactgtttggacttataaaaatggagaagctgatgggagatta

SEQ ID NO: 2446 - DNA, 102 bp, Arabidopsis thaliana
ttctttctctcatcgaagtctaaggaagatggagcgaggagctttagtgggttcttcttctacttctagctactatgttccttaccactttcgccaatcaaa

SEQ ID NO: 2447 - DNA, 79 bp, Arabidopsis thaliana
agtggatctgcagcagcatcagggaacaaaacaggaggactgttctggccaacacaaaactgatcttgttgttgtctat

SEQ ID NO: 2448 - DNA, 116 bp, Arabidopsis thaliana
ctcaagacagattagcttcggctgctgttgccatagctgctgcagctgcggtggcaaaagctgcagctgctgccgccaatgttgcagctaatgctgcattgcaggccaagttaatg

SEQ ID NO: 2449 - DNA, 75 bp, Arabidopsis thaliana
tgttctctctatctccatctctcacgagtcatggtgactctatgtgtctcagagagataagaagaagttgtacat

SEQ ID NO: 2450 - DNA, 107 bp, Arabidopsis thaliana
aacccatcactagatttgtctcactctctcgattcttctatttcttcgtcttcttctatggagagagagagcgacagagtcgtgtcttgatgttataaaattgttca

SEQ ID NO: 2451 - DNA, 92 bp, Arabidopsis thaliana
gaatacgaaatttgaaaagaagagagtgggacattggaaacagaaaaaccaaattccctctgcttcatcttcttcctcaatttcaaattcac

SEQ ID NO: 2452 - DNA, 89 bp, Arabidopsis thaliana
tttgaaatggagacggttgcttgagaatgaggaaaaagagttagtaagtttttaactctctctttctctctccctctctctttttcaac

SEQ ID NO: 2453 - DNA, 106 bp, Arabidopsis thaliana
actagcttatatgggaaacattagtgttgaactttgtgtctgtgtgcagggagaaatgcagaaattgaaagataaactcgctgtttccgagagaaccgctaaggct

SEQ ID NO: 2454 - DNA, 80 bp, Arabidopsis thaliana
taaagagggtactataaatgccaaaaatgaagaaatcaaggtaacttcatcatcttcttgtggttgtttaagatcctcaa

SEQ ID NO: 2455 - DNA, 88 bp, Arabidopsis thaliana
agcaaagaagagggtgctgcggctgagatgggaaacatatgatatagaaaaaatgtgttttcttctttctcttgttgtaatgtatttc

SEQ ID NO: 2456 - DNA, 85 bp, Arabidopsis thaliana
accctcaaactgtgcgtttggtttcttggattggatgtggctcactgtgttggattggtggagcaggaagctcaagtggcagggt

SEQ ID NO: 2457 - DNA, 83 bp, Arabidopsis thaliana
atgaaaatgtatatgatgtctctgattatgtgtgtactcatttatatacattatcttggatgttgttggcgaaatgcagcacg

SEQ ID NO: 2458 - DNA, 109 bp, Arabidopsis thaliana
atttttccaatttcgttttgttctctatcaatgtttgtgtgtgtatatgatcactaggatgatctatctatatgagggaatagagagtggtggtggtggggattgagag

SEQ ID NO: 2459 - DNA, 126 bp, Arabidopsis thaliana
tctgcagaaggagcttgccttgtatacagcttccaaagttagtagtgagtttttatgctttgatattgatggtgacatagacccaatgttcaaggtgataactctctctctctctctctctctctc

SEQ ID NO: 2460 - DNA, 106 bp, Arabidopsis thaliana
gtttgagagttgcgatcccatagagacaagaggtgggtttgaggagagagagatatgtctttggttaagtttctgttgtgtttgtgtcttgttcatcttaagtctt

SEQ ID NO: 2461 - DNA, 125 bp, Arabidopsis thaliana
ggcagaggcttgtggatgtatcttggtggttatgttattccttccatttctaaagggtttgtttgagcatggaaaatatagcatcccattgtctactctttctaaagctgcctttttgacagttt

SEQ ID NO: 2462 - DNA, 76 bp, Arabidopsis thaliana
agtgcagttcttcttctactacttctaattaccatcatgaaggagaagaagaagaagaatgtggtaatggagaagt

SEQ ID NO: 2463 - DNA, 102 bp, Arabidopsis thaliana
aaagaacacatgaagattattttgctctgatttgtctatctgttgatttcgatttctctttcatagaagttgagtgagagcaacaatggagattcgtaaaat

SEQ ID NO: 2464 - DNA, 69 bp, Arabidopsis thaliana
tcactctccccgtcacagtggtgatgttggtgatcgtttttcactttcatcgatcggtggtgcagcctc

SEQ ID NO: 2465 - DNA, 137 bp, Arabidopsis thaliana
aaatatggagattacaacatacacgctagacgctacaacatacacgctagacgcaaacagtttatgtttgatgtttgcatgaaatatgagtgtaatatagtttgtgttcttttgatgttttggtgtgacagattaag

SEQ ID NO: 2466 - DNA, 104 bp, Arabidopsis thaliana
acaatctgagcgagagtacctgttgttctgtctttcctgaatctttagcgattctttttcttctctctggagattctgctagtaactctggtctctctctttcc

SEQ ID NO: 2467 - DNA, 115 bp, Arabidopsis thaliana
ataatgatgatgatgatgatgattatcttatgattgaacttacaattccaatgtcttacataatgatgatgatcatgattaaacatatcaataatttagttgtacattttttaat

SEQ ID NO: 2468 - DNA, 123 bp, Arabidopsis thaliana
ttatgcatatgttttcgagacagatttatagagagtaaatcgtatcaaagttttatagtttgatggtgcaaatgaacttggcttgagctgaagctttgtaggagctttcatgacttctggatt

SEQ ID NO: 2469 - DNA, 108 bp, Arabidopsis thaliana
gtttgataatgtgatgttatgtatgatattataagtatgtgtatgttaagtatgattatgagtatgtatgtatgatgaatgtatgagtgggagaatcgagctatgggc

SEQ ID NO: 2470 - DNA, 139 bp, Arabidopsis thaliana
gataaagtgtgatcgtggaatcatggcaaggaagagaggatgatctaggaactcgtttgttttatgtttggtgtttttggttattggaacccggttaggattgtcagttattcttggttttgttgatcgaattatttat

SEQ ID NO: 2471 - DNA, 159 bp, Arabidopsis thaliana
gataaagtgtgatcgtggaatcatggcaaggaagagaggatgatctaggaactcgtttgttttatgtttggtgtttttggttattggaacccggttaggattgtcagttattcttggttttgttgatcgatttatttatttattcataaaatagtattt

SEQ ID NO: 2472 - DNA, 81 bp, Arabidopsis thaliana
gagttctcaccgccgcttccatggtggttcaaatcgtatcaccaaggctttgctgaaactctgtcatcatctctctgaacg

SEQ ID NO: 2473 - DNA, 122 bp, Arabidopsis thaliana
ttgaacacaggaagaccatcaagttttttttatgtcaataccagttttgttttcagtggcttttgattaagacttatttgggttggtctgagtagtttttggtttgaatgagcataaatcag

SEQ ID NO: 2474 - DNA, 100 bp, Arabidopsis thaliana
agtgataacttggaacatgtcttttgtcatatattcaaagtgatttataagctgagtctttcttgttgattttgcagttggacggtcctcgcacttacta

SEQ ID NO: 2475 - DNA, 125 bp, Arabidopsis thaliana
tttagagcagctagagattgatttgtgatttatgattgtgattgtgctagagtgttatttgtgatgtgttactttagttcttgtgatttgtcaagtgtaattgttctagagtttaaaaagttagc

SEQ ID NO: 2476 - DNA, 92 bp, Arabidopsis thaliana
atcgagctcttcctctgagatcgttcacttgaagtttctgaagaaaaatttgaggtttggtctctcttctctgatcttgattttcttataac

SEQ ID NO: 2477 - DNA, 87 bp, Arabidopsis thaliana
gttactcgacctatcactagacctcacccagtgctctgcaaagagctgtgttggtcaagtgttttattgtttctgcttgaatttctg

SEQ ID NO: 2478 - DNA, 79 bp, Arabidopsis thaliana
tcggcaaagtttggagcctccaaggatcacattgatcttccccttcgaactccttggttcttctttgttggtcaatctt

SEQ ID NO: 2479 - DNA, 84 bp, Arabidopsis thaliana
ggtttttgctgggccgaaactggtgtcgatcgacacaaagagtgattcgatcgacactcctcgctgatttctgaaccaaaatcg

SEQ ID NO: 2480 - DNA, 81 bp, Arabidopsis thaliana
aaattgccatcatcggtgatcatccactcaacatggttcgcttcttcactagataacgggtcatgatgatcatcatcattc

SEQ ID NO: 2481 - DNA, 93 bp, Arabidopsis thaliana; identical to SEQ ID NO: 78

SEQ ID NO: 2482 - DNA, 139 bp, Arabidopsis thaliana
atttttaaataagacagacagttaaagttaggcatggaaacttatggttgaacttaaaatgggacggagggagtactttcttttattgaaaggaaataatattgtgggttgctgtgttcttttggagggtttgggaacc

SEQ ID NO: 2483 - DNA, 92 bp, Arabidopsis thaliana
atgatgataccagtgaatcagaggaagatgaagaacaagtagatgacgatgagttatctagttggaagaagttgtttatcctttttacgttg

SEQ ID NO: 2484 - DNA, 79 bp, Arabidopsis thaliana
aactacgaatattaacttcctctgaattgtgagtgttgatcgacatagaaggagtgtcgatcgacactaaagttcgatt

SEQ ID NO: 2485 - DNA, 80 bp, Arabidopsis thaliana
atgttttctgatctgggttcttcttcttcctcgacgagatcgagatttcgttgagagaatgagagagagagagagagaaa

SEQ ID NO: 2486 - DNA, 82 bp, Arabidopsis thaliana
tcgaaatctgcttcacatgttaacaagcctagagttcctcgaaaacttgtttcccctgttgttgttgcaggtgacgagaaga

SEQ ID NO: 2487 - DNA, 137 bp, Arabidopsis thaliana
tgtccttgaatgatttattgaatgagttgcttaatttctggatcttgagctgctgggacttgttgtggtggttgtgtgaaccctggtggtggattctgttgttggtagcctccattaaattgttgtttagggacata

SEQ ID NO: 2488 - DNA, 111 bp, Arabidopsis thaliana
acccttggtcgagtaaatgggtcgagtagaggatcgagtagaagggtcgagtagatcaatctgcttcttcttctaaggctgtcttgatcgagtaagagggtcgagtgaatt

SEQ ID NO: 2489 - DNA, 96 bp, Arabidopsis thaliana
attgtgtagccgtagtgcgtatgagtctttggctttgtgtcttctaacaaggatacaaggcttttaagatccggttgcggttctagttgttatact

SEQ ID NO: 2490 - DNA, 86 bp, Arabidopsis thaliana
caaagcccgtatgagtctttggctttgtgtcttctaacaaggatacaattcttatgcctataagatccagttgcggtttaagttct

SEQ ID NO: 2491 - DNA, 132 bp, Arabidopsis thaliana
ctggaggtttgtacacttacaaatgctggttcttgctctagtgtaacaaggtatgagtctggtggtggtggtactcaaggctatgttagagaaggttacaatcagcctgtgactggttatgttgacaatgat

SEQ ID NO: 2492 - DNA, 74 bp, Arabidopsis thaliana
attgttggttttgaagttgttgtatcctttgtagccactctggttgttgttgatgtagctgacttcttccaact

SEQ ID NO: 2493 - DNA, 74 bp, Arabidopsis thaliana
attgttggttttgaagttgttgtatcctttatagccactctggttgttgttgatgtagctgacttcttccaact

SEQ ID NO: 2494 - DNA, 73 bp, Arabidopsis thaliana
tgctcctgcagcttgtccttggagaatctgctgtaacatgttcttcaagtctgaatctggagttgttgaagct

SEQ ID NO: 2495 - DNA, 74 bp, Arabidopsis thaliana
attgttggctttgaagttgttgtatcctttgtagccaccctgattgttgttgatgtagctgacttcttccaact

SEQ ID NO: 2496 - DNA, 88 bp, Arabidopsis thaliana
gaagattttttggcgtagtctctaccaagcagacattgatggtagacgtattgaaactgttgatgatggtccagctgtacctgaaatc

SEQ ID NO: 2497 - DNA, 86 bp, Arabidopsis thaliana
agtcgaagcaggtggtgatggtggtgccacctcccaaatcttcgtcgtcccaataatcttatcacgtttctctcactctctctcct

SEQ ID NO: 2498 - DNA, 125 bp, Arabidopsis thaliana
attcagcctttgctacaaaaatcggagtctagagatgatgttcgtgctgagtttgagagaggtttggaggaattcatgcgtgggcacttggacgagtgtatctcatttgggtcttgtagttctgt

SEQ ID NO: 2499 - DNA, 97 bp, Arabidopsis thaliana
ttacacttgtcaatcatctagccactctcttcttctgatgtgataggactgaaacggttacatagtacgatggtcggagagtcagctggttgactct

SEQ ID NO: 2500 - DNA, 82 bp, Arabidopsis thaliana
aacttgatataatacgatttgctatataatctagaggtctaaaatgattaattgattgtcatagctgtttgtttatatcatt

SEQ ID NO: 2501 - DNA, 82 bp, Arabidopsis thaliana
acatgatgatatgaatttatgattgttgagtatgatgtttgataatgtgatgttatgtatgatattataagtatatgtatgt

SEQ ID NO: 2502 - DNA, 82 bp, Arabidopsis thaliana
ctaggctttggaccggcgattgttatccaaagagagagagagtagctcatcttggtcatagtcttggcggattccttctcca

SEQ ID NO: 2503 - DNA, 90 bp, Arabidopsis thaliana
tatcccaaattgtgtgtgtctctctctctctcgctgacacttgtatgagtaatgtgatcgaagaagtagagaaagacatatcaaaagaaa

SEQ ID NO: 2504 - DNA, 76 bp, Arabidopsis thaliana
acttaacaaggcactgtatggtttgagacaggccccaagagcttggaacaacaagttaaatcatattcttgttgaa

SEQ ID NO: 2505 - DNA, 88 bp, Arabidopsis thaliana
tagcagtgtgagagagagagagattcagtgatgcgttctcatgtttgattttgtttttttgtttctttttttagcctgcgaagcctga

SEQ ID NO: 2506 - DNA, 153 bp, Arabidopsis thaliana
tggaggatatacttggtcttgtggattagcaacgttggtgctgcggtaggagaggttggggttgttggttttgaagttgttataccctttgtagccactctggttgttgttgatgtagctgacctcttctaactggttatcctccccatctta

SEQ ID NO: 2507 - DNA, 92 bp, Arabidopsis thaliana
aagaaatcgatcatgatgtgtttgctttgttggttgatgagtccgctgatatttctgacaaagaacatatggctattgttttttgatttgtt

SEQ ID NO: 2508 - DNA, 115 bp, Arabidopsis thaliana
atcattttgcaccactttagcttgttttgcatacttaggcatctaggatcatcttgcatatgcattgcatgttttggtgtgctttcaggtgcagaaggaggtaaaaaggactcaa

SEQ ID NO: 2509 - DNA, 84 bp, Arabidopsis thaliana
ttatgagatttttatcaactttatccataatggaaagatctaggatcaaaataaaatggatgatgttgatgatgttttctcata

SEQ ID NO: 2510 - DNA, 126 bp, Arabidopsis thaliana
tgcccaaaatatcttagctttgtctgttggatattaggcttttctagatttctattgcattttccttctattgtgttaagaatctaagtttgatttcttctacaaagttgtttatcttgttgagtt

SEQ ID NO: 2511 - DNA, 110 bp, Arabidopsis thaliana
tgtaattgttgatttttcctagttgaacaggctgcatatagatatagatatcattagttgtaacttaccatgcatttgttctctctttcttacattgaattgttgcagaa

SEQ ID NO: 2512 - DNA, 106 bp, Arabidopsis thaliana
agcacctggtgaagatagtgaagtgattctatagtaagaattttttgtcacatttataatctcattctctcttttatttcacaatctcatacaccattgttttatt

SEQ ID NO: 2513 - DNA, 132 bp, Arabidopsis thaliana
gtgtgtttggtcttctcgaacttgcttctaacgctatttcaaacttggaaaattttgattttcactctttatcatcttgtttgttcaatgagattagccgttttgtttgtatattgggtgtgtccaattatg

SEQ ID NO: 2514 - DNA, 83 bp, Arabidopsis thaliana
tgctcgcttggtatttgaggatgaatgggaggaagagtcacggcgttatcgtcagtgcttttgttgatcttctctctggactc

SEQ ID NO: 2515 - DNA, 110 bp, Arabidopsis thaliana
ttgtaggttttataatggaacgaaatctttgtgaagaagatgattcagatgtagatattatgttattgatggtggttggatccgttgatgcttatgaaagtcaaatccca

SEQ ID NO: 2516 - DNA, 100 bp, Arabidopsis thaliana
ccgactacccaaaggtaaccgagaacacgtcttagggaaactattctgaatctacttttcttttgatgttggttcctactttggtgatatttagatctta

SEQ ID NO: 2517 - DNA, 80 bp, Arabidopsis thaliana
aaaaggcgtttttctgggttatccacaaggagttaaaggctacaaagtgtggttgttggatgaagagaaatgcgtcatta

SEQ ID NO: 2518 - DNA, 77 bp, Arabidopsis thaliana
tgtcaagtgtgtggttgtggtcatttcaggtagaccacttgtgatggaaccttacgttgcctcgatcgatgcattgg

SEQ ID NO: 2519 - DNA, 77 bp, Arabidopsis thaliana
cggaagcagaaggattctttatgaaataacaacattttgttggtacgaagagagttgttcttcttcttctcgtatcc

SEQ ID NO: 2520 - DNA, 100 bp, Arabidopsis thaliana
tgagaatctgacatttcttctggtaactttttttgtgtgtgtagcttaagccgactttgagaagatgaaaagttacaaaagcttggagtagatagattct

SEQ ID NO: 2521 - DNA, 130 bp, Arabidopsis thaliana
aaccttgtccaccaatcttttagtgtgtcttgtgattatgattttgcagctccggtttacttgaactgtatatcttagtatctaagtttatttgacatggtgaaatggtaggataattgattcatttagt

SEQ ID NO: 2522 - DNA, 77 bp, Arabidopsis thaliana
tcaacctcttttgtctattttggatgatgtattttcggaagttggttctctttaagatgatattatttaggttgact

SEQ ID NO: 2523 - DNA, 109 bp, Arabidopsis thaliana
ggttatcattgctgacaactacgtgcctccctttttcgaggttttgaactgggaggaatttgctgtgtttgttgaggagaaagatataccgaatctgagaaacattctg

SEQ ID NO: 2524 - DNA, 79 bp, Arabidopsis thaliana
aaacgatgaaaatgcattggaggttgattttggagcgctggatttcactcttccttggctttcgttgtcatcttcaata

SEQ ID NO: 2525 - DNA, 73 bp, Arabidopsis thaliana
ctagacggtaaagacgatgacgagctaattggtggtggcttttctcttcatgctcgtcgtcctaatgctcacg

SEQ ID NO: 2526 - DNA, 72 bp, Arabidopsis thaliana
aggaaaagtttgcagtgttgttgctttggattctttaactttatctttgtagcttatgttgtaaagtttttt

SEQ ID NO: 2527 - DNA, 102 bp, Arabidopsis thaliana
aatgtatggtgtgaaggaacagctgctggtgttgatgctgatcttagatacagttatctgatgaacactagcatcagtggacttgaaaacgccgatctcttc

SEQ ID NO: 2528 - DNA, 95 bp, Arabidopsis thaliana
gaagatgaagaagattataatcttcatgttgatgctgaggtcaacaatgatgatgatgacgatgaagattatgtatttgatgaagattatgagga

SEQ ID NO: 2529 - DNA, 95 bp, Arabidopsis thaliana
ccagagcagttgtaataaaaggttcctagctcggtgtcttgaagaaatggaaggacttcttggttgattgatctgttctctggatgccaaggaca

SEQ ID NO: 2530 - DNA, 121 bp, Arabidopsis thaliana
tcgtgctttgcctgcgcttgaggaattagtcatgaatcatatatactggaaagaattggatgtgaatgtgcatgtatctgtatcaagtgcaagcctcaagaccctaacaataaaatgcatc

SEQ ID NO: 2531 - DNA, 137 bp, Arabidopsis thaliana
acaaagtttcaatcttttactttggttcctctctctctctctgtttattagggttctgggttctgttgatgatgattctctaactaatgaggtagagttataacccaaaaataacaaaagtagagttaagtctttga

SEQ ID NO: 2532 - DNA, 104 bp, Arabidopsis thaliana
catcactgtgtttccggtttggttcttggtctgattcttttggtttacttttctattttttacagatcgttttgcctgagaacaagaagaagatgatggttcat

SEQ ID NO: 2533 - DNA, 91 bp, Arabidopsis thaliana
gttttttctttctcttgttgtctctattattatgtactatgttttgaaacagaccagagaaagagagaaagagtgagagggagagagagat

SEQ ID NO: 2534 - DNA, 72 bp, Arabidopsis thaliana
tctgagaatggagaagttcatggaaaggtttgatttcttgagatcattctttgtgtgttgatcttgattctt

SEQ ID NO: 2535 - DNA, 100 bp, Arabidopsis thaliana
tggaaaggtataacatgaaacattttatcacttttcatcaaactactcaagataatgatgatggtgatgatattgtgtaacgttatgttgctgcaaaagg

SEQ ID NO: 2536 - DNA, 91 bp, Arabidopsis thaliana
tttatttactaagtttctcatctggtgattggtgtttgtatagatgaattcaaggagttctttatgcaatttggagagctgaaggaacatc

SEQ ID NO: 2537 - DNA, 132 bp, Arabidopsis thaliana
gtatgggagggggcggtgggtacggtggtggaccaggtgatatgtatggtgggtcatacggtgaaccaggaggtggttatggtggacctagtggcagttatggaggcgggtatggtagtagcggaataggtg

SEQ ID NO: 2538 - DNA, 103 bp, Arabidopsis thaliana
gcgaaaagagagagcagatttgcaagagaggtctctatgttgtctagagttcaacacaaaaatttggtcaaggttctgcttctttgcatttatctaatctcca

SEQ ID NO: 2539 - DNA, 60 bp, Arabidopsis thaliana
atctctgaagaaaggtgcgaagtactctttgtgcttcttcatctgtctctgtagaaaatc

SEQ ID NO: 2540 - DNA, 137 bp, Arabidopsis thaliana
tgagtttaatatatgttacgatgatgttgatgatgttgctgttatgatgatgtggatgatttgatggtgttgatgttattaatgatgaggctaatgatggatacgaatcttgtacaggcgtgtgtgtgtgttgttga

SEQ ID NO: 2541 - DNA, 107 bp, Arabidopsis thaliana
ctggattgaatttggggttacagacagaagaatgtgttgcttttgattctctagcgattggggaattcagaaactccttgcttctggacttgttacccttgtgaaaa

SEQ ID NO: 2542 - DNA, 62 bp, Arabidopsis thaliana
acaagtggttcggatcatcatcatcatcatcatcagacaagtggtggtactgatcagaatca

SEQ ID NO: 2543 - DNA, 88 bp, Arabidopsis thaliana
aacacacgcagatgatgatgatgatgatgaatagtcaccaccaaaacaacaacaataacaatcatcagcatcataatcatcatcagtt

SEQ ID NO: 2544 - DNA, 137 bp, Arabidopsis thaliana
aagttattaattgtgatggaaaaataatacatgtgaatgtgatcaaattgtagatcaatgcatgatgatgatgttgacactcgtcaaatgtcgatcttaatgtacgattttgtcctcataagggtattagtagccga

SEQ ID NO: 2545 - DNA, 144 bp, Arabidopsis thaliana
tttccttacactgatattcacaaatggctttcttatgggcacggtacttgtttgtttacttgtctttctttctttctgtcacactctttaaaggttagaaatggttgtgatgaattgtatatttgtctgtgtttgtgaatctgt

SEQ ID NO: 2546 - DNA, 100 bp, Arabidopsis thaliana
tattggcagaacttgatgcagtgcttgatgttggaggtgtttatgatccggagcatgaccgttatgatcatcaccagaaaggttttgaagaggtttttgg

SEQ ID NO: 2547 - DNA, 81 bp, Arabidopsis thaliana
actctttcactaataaatgggcagctaaatctctttgtgatcttcatagcagctctgtatattaggaggattgagacaaac

SEQ ID NO: 2548 - DNA, 60 bp, Arabidopsis thaliana
tgaaatgagcagtgattcttttcagctacttggaatggctgagagggggatgcttcccga

SEQ ID NO: 2549 - DNA, 104 bp, Arabidopsis thaliana
aatttaatatatatattttaatcaagttcaggaacgatatatatatttataaaccctgatatattttatatatttggttctccgattgtaatcagtatgttgaa

SEQ ID NO: 2550 - DNA, 71 bp, Arabidopsis thaliana
ttgctttttcctttgttggcttttggagggttgttttatctctttagaggaggtcaaggaggtgctggtgg

SEQ ID NO: 2551 - DNA, 74 bp, Arabidopsis thaliana
aaacatatgcaaacatgtctcttatctgtgtcttacaatgcgtgtgtgtggaagagagagggtgtttgaaatta

SEQ ID NO: 2552 - DNA, 134 bp, Arabidopsis thaliana
aggttggaaatttgtgacagagatgacttactttaagtaaacttatcaatcacaggatattggttgcttgcttgacagtttttgagagagttggtgatgcgtttgtttcatggtgggcatttctaaacgaaccc

SEQ ID NO: 2553 - DNA, 85 bp, Arabidopsis thaliana
acggctgcaaaagctggtgaactattggagaatgatcttggatttgctgctttgaaagtgcatcaagcagtagctgaacatacga

SEQ ID NO: 2554 - DNA, 80 bp, Arabidopsis thaliana
aggaagagtgagaatgtggtggagatcccatcgggctggtgagtaccggtgttgagtggaatgatgttgctgttttctcc

SEQ ID NO: 2555 - DNA, 134 bp, Arabidopsis thaliana
tcacaatgttgggcgatgataaagattcagacgaccttaatttatttctcaacgccattggtgaagctggtgatgaagaaggtccaacgtctttcaatgacatcgacttcttgacattcgacgatgaagattta

SEQ ID NO: 2556 - DNA, 86 bp, Arabidopsis thaliana
caaagagagagagagagagagacgaagacagagaggtcttgcttaagcttttgtctggatctttcttcttctactcgaatattatt

SEQ ID NO: 2557 - DNA, 138 bp, Arabidopsis thaliana
tactctatttgtgattgtgtgtacattaaaatgtttaacattcattgaaaaacatgaatccttctatatatatatagaatatactaacattaatgtactcgtcatgcaatggagtggcataacctctttgactctgtc

SEQ ID NO: 2558 - DNA, 82 bp, Arabidopsis thaliana
ccaatacccttttgtttgagggttagatgaactacacatgctttggttatcttcatcttcttcctcgtaacaacttcttcgc

SEQ ID NO: 2559 - DNA, 88 bp, Arabidopsis thaliana
gctacgacgggccgcgcgcgggttatttgggctttctcagttcaaacctttgagttacccgctctctcttcttgctccaatcaatctt

SEQ ID NO: 2560 - DNA, 134 bp, Arabidopsis thaliana
ttataattctgtaagtgtttcactttgctgcttctttcaattgaatctacttcttggtgttgactgatttcttttacttgtgtttgtttatactgaaaggcggcatcgctgttgaagatactgttcctggatga

SEQ ID NO: 2561 - DNA, 76 bp, Arabidopsis thaliana
taatttaattgttatatatatatatatatatatatatatatgtgtgtgtgtgtgtgaatcaattatggatcttaat

SEQ ID NO: 2562 - DNA, 108 bp, Arabidopsis thaliana
agttcaggtgaatgatgcctggctcgagaccattcaatctcatgatctcatgattataacgatgatgatgatgatgtcggaccaggcttcattcccctcaacttacac

SEQ ID NO: 2563 - DNA, 79 bp, Arabidopsis thaliana
aagcttagtacttgtaggctactgtgacgctgactggggagggaatcttgatgatcgtcgaagtaccacaggaggagtg

SEQ ID NO: 2564 - DNA, 132 bp, Arabidopsis thaliana
ctccggaactgaagtctcttcaaactttgtttgttcatagcttttagagttagtttactctgtgtgtgtgagatttgtgagagtgagaaaatgtgtaagaagtaacaaagaagcaaagaatgtgaggaacat

SEQ ID NO: 2565 - DNA, 85 bp, Arabidopsis thaliana
ttctcgcttcgatcttctctttggtttgggttcggattgatccgttcttgccgaaacagactggtccgttactgaagcaatgtgg

SEQ ID NO: 2566 - DNA, 85 bp, Arabidopsis thaliana
ttaaatttgcaaaacacggttcaatcggataacaacacctagttggttactcaaatcatatggttgtgtgtggttgtcatgagct

SEQ ID NO: 2567 - DNA, 87 bp, Arabidopsis thaliana; identical to SEQ ID NO: 52

SEQ ID NO: 2568 - DNA, 73 bp, Arabidopsis thaliana
gattgttcagatttgatgaagatggtgtttttccaaaacgaatgaccagcattttcaacatatttgaaggaga

SEQ ID NO: 2569 - DNA, 139 bp, Arabidopsis thaliana
tctatcactcttgtccattaaaaatttacaaaaaattatatatagttattttttatacacatatgtgtagatatatagattactaggtatatgtatatgtgtgtgaggatctttatgcacctttattttttgccagtgc

SEQ ID NO: 2570 - DNA, 111 bp, Arabidopsis thaliana
ttctctctcttgcgcttctttgtagtatgagatctacatgatatttaccgctagctcacttgtgttgtctgtgttaactcatactgcacttttgtcattgttaatgttgtt

SEQ ID NO: 2571 - DNA, 112 bp, Arabidopsis thaliana
gcactataaggaggtacatcatgtagtccgaaaggattttgctgaactctcggttactgtgttcttctttctctcggttagtactgtgttcttctttctctgtgactttttt

SEQ ID NO: 2572 - DNA, 111 bp, Arabidopsis thaliana
ggtagatagtccaaaacccttgcagaagaagtctgttgcagctccaacaacaaagacgtttgatgatgatgttgtggatgtcactgacaaggttaatgcagacaatctgaa

SEQ ID NO: 2573 - DNA, 97 bp, Arabidopsis thaliana
atataaatgtgactgtatgtatgtgtagatgtgtttgaaagtatacgtgtacgtataaacaaatcgagctagtatttgcatatgatgatgtcattag

SEQ ID NO: 2574 - DNA, 104 bp, Arabidopsis thaliana
gagaaggacacgtcattgcgttgtttgtggttatgtggcgagaaatattgagattgagctttgtggatgacacgtggatatgttaatgatggtgattacctttg

SEQ ID NO: 2575 - DNA, 75 bp, Arabidopsis thaliana
agaatcttgtatcggaatcatgcgagaagagcggtttgcagtcatcaagcatggatcatgatgcagctgagtcaa

SEQ ID NO: 2576 - DNA, 100 bp, Arabidopsis thaliana; identical to SEQ ID NO: 1682

SEQ ID NO: 2577 - DNA, 121 bp, Arabidopsis thaliana
actaatattggcagcttgatgcatatctgattgtagatttgaagtcttaactactcttaattggatttcattgctttcatgtatcctgtaggagttgctccaattggaagaagatgtgaac

SEQ ID NO: 2578 - DNA, 86 bp, Arabidopsis thaliana
acgaaaatgagcagagagagaagagttgatgatgatccatgttgtgtgtgatctcttctttctctctttgaacaagtcttcttctt

SEQ ID NO: 2579 - DNA, 100 bp, Arabidopsis thaliana
ggagtatcgagtgtgagagtcagagtgaggaggaggaggaagccaaagcggcgatagaagtttcttttttcttattgagggtttgtgtgttaaaaatact

SEQ ID NO: 2580 - DNA, 138 bp, Arabidopsis thaliana
atgcctgtataacccatgcttagtggttttcaaagagatggagaaatgatgaagaaacaatgtatttatgtatgtgtaaaagatatcattggattggatcataccacaaaactctttttggaagcacatggaggtggg

SEQ ID NO: 2581 - DNA, 108 bp, Arabidopsis thaliana
gagttgctcagagagagatggggtttttgtggtgattggttcttcttctagggttttaggttgtttcaaggaactgcaagaaatgttaagctttctggaacgagattg

SEQ ID NO: 2582 - DNA, 106 bp, Arabidopsis thaliana
gtctgtctatatattgtctatgtgtatcagtgtatgtgtgtataatttatttagttatcacaatattttttctgaaaacatagcaatagtaatttagatagtaaaa

SEQ ID NO: 2583 - DNA, 86 bp, Arabidopsis thaliana
aatgaggtgagtgttgagtttctttctgtgtgtatgtagatcggctaggttgtgcggtagtgatgatattttgcattctctcaaac

SEQ ID NO: 2584 - DNA, 125 bp, Arabidopsis thaliana
tatagatatacttaaaagagcattgagtatctgagaacaatataatttgctgcatttgcatatgtagatatagaatcatagatatgtgtgaaaaaacttattgactaagatattgatagctccta

SEQ ID NO: 2585 - DNA, 121 bp, Arabidopsis thaliana
gcattggtatgtctacatcttcatgaatctttccttttgtgaccatcatgatcatgatgctgagattgttaatggggtggtgcaggaagtgtttgataaagataggttcaaggcagatgac

SEQ ID NO: 2586 - DNA, 108 bp, Arabidopsis thaliana
attaaacaaaagaggaaagagaaagctggcaaatgggaggtccctcttccaaaggtgaaatctctctctctgcttttgtattccttcagtgtttgaactctaacaaat

SEQ ID NO: 2587 - DNA, 135 bp, Arabidopsis thaliana
atttccgaataatacaacaacagaaatcttatacttataacaaaagacaagaggcagcttgtggtggtgtagaagaagatgttgttctggagcaattctagtttatgtctctgcaaagccggccctgacaatata

SEQ ID NO: 2588 - DNA, 131 bp, Arabidopsis thaliana
tgttcccacaaaataattgtgccataaacattttgagactttgttagttgttacaaagagtttgttattctacatgttttagactataaatgtgcttatagtgttatgtttctgcttaattaactacgtac

SEQ ID NO: 2589 - DNA, 79 bp, Arabidopsis thaliana
aatctatcgacgagctgctgctgctgagttctattatcaatcaaggtcgtcagttgctgcggcttgtacgtgatgaaaa

SEQ ID NO: 2590 - DNA, 88 bp, Arabidopsis thaliana
aatagtacaacttcccgatgaagatgaagatgaaggtgaaggtgaagatgataatctgccactccccctcttcaattttctcaatcta

SEQ ID NO: 2591 - DNA, 71 bp, Arabidopsis thaliana
aaagaaagagagagagagctttgctttgcagaaaaaaatgcagaacttttggttcgccatcttcttcttcc

SEQ ID NO: 2592 - DNA, 108 bp, Arabidopsis thaliana
acttctttgcttggcctatcttatagattttatctttgtctctgatgaattatacaaacatgattctgcagatgatcactctgggaggtgatgcagagctggagctgg

SEQ ID NO: 2593 - DNA, 159 bp, Arabidopsis thaliana
ggacttgcaaatgaccatccccagcttctgttccttcctccaccaccatgacccatgttatgattatgatgatgatgatgttcagctgatgatgatgatacccatgatgatgaagatgaagaagaagacgatgacgtcattatcataaacccaccaaag

SEQ ID NO: 2594 - DNA, 61 bp, Arabidopsis thaliana
tcgagaaagacgccgtcatacttgcctcacaggtctgtgtgtgtgtctctctctctctctc

SEQ ID NO: 2595 - DNA, 96 bp, Arabidopsis thaliana
agcttagaggaggtaactggggcaagtagaactaaaatatttctataatgtttagtaggaatgtatggatgtgaatgtttcctatatcttctctac

SEQ ID NO: 2596 - DNA, 72 bp, Arabidopsis thaliana
agagattcttttggttatgttgcaggttcggttttgaaaagaactgtgtggttgtgcagtggtcgggagata

SEQ ID NO: 2597 - DNA, 94 bp, Arabidopsis thaliana
agtacttctggaaggatttatgcttggtttttgtggatgtagaatagtcaaaagtagccgggtacagatatcacgaatacccagcatgccttcc

SEQ ID NO: 2598 - DNA, 66 bp, Arabidopsis thaliana
aatcacagatgatgatgatgatgagtccttggacaaaagaggggtttcataatcatccatctttat

SEQ ID NO: 2599 - DNA, 68 bp, Arabidopsis thaliana
tcggaggcaatagtgtcaggtggagaatggtgtgtgagcttgacgcttggcattgttgttgttgtaaa

SEQ ID NO: 2600 - DNA, 91 bp, Arabidopsis thaliana
atgagtttgtcattggtcaagagaaggctaagaaggtttggtttcggtccctagcttcttcttctttgtgtctaaattagattcttgttta

SEQ ID NO: 2601 - DNA, 65 bp, Arabidopsis thaliana
aacgagaggagctgttgctgctgctgcatccacaatatggaagcaccgaagaaacccttctcttc

SEQ ID NO: 2602 - DNA, 96 bp, Arabidopsis thaliana
atgggaagatgaggttttgtgcagatagtgattcagatgtgtcgaaagggatgtgttcttgtttgattcaagttcttgatgaggcttctcctgtag

SEQ ID NO: 2603 - DNA, 77 bp, Arabidopsis thaliana
ctatgctgaggcagattgcattgcagttgctggtaaagagtactgtgttagtgcagtaacctttatgcaaatcccaa

SEQ ID NO: 2604 - DNA, 114 bp, Arabidopsis thaliana
cagcctttggattcgactcaagagagctgctttagcatcttcctcttcttctagcttttataatcacatcaaaagaaaatcatgcaaagcagatttcaagtctccacaaactga

SEQ ID NO: 2605 - DNA, 84 bp, Arabidopsis thaliana
aacaaaaatggtatcaatcaatgagtgacgttacctcgttttgatcagatgatggtgttggtctcatgtaatgttggattgaga

SEQ ID NO: 2606 - DNA, 68 bp, Arabidopsis thaliana
aaatcactaaggatcaggatgatgatgatgatgatggatcgtcgtcgtcgtcgtacatcgttttatcc

SEQ ID NO: 2607 - DNA, 68 bp, Arabidopsis thaliana; identical to SEQ ID NO: 2606

SEQ ID NO: 2608 - DNA, 81 bp, Arabidopsis thaliana
atcaaatgaaatgagttatgggttagacccaactcatttaacaaaatgagttgggtctaacccataactcatttaattata

SEQ ID NO: 2609 - DNA, 86 bp, Arabidopsis thaliana
acaaaataattatcgttatgttagaattcacgatgtctcatgtaaatgcatgcattttgaattttatacgttaacgtgagaagata

SEQ ID NO: 2610 - DNA, 134 bp, Arabidopsis thaliana
ttcaagaaaagcagattggtctttggagagtctaagtttcttcctagtggatccattctcgtcatcgttgtcttcgttgctggctcttgaagctgatctctccacttcatcatcaatatctctcttattgcttc

SEQ ID NO: 2611 - DNA, 65 bp, Arabidopsis thaliana
gattagtattgcagaagccagtgctcctggatttctcttggtgtgcacctgcatctgatcatatg

SEQ ID NO: 2612 - DNA, 72 bp, Arabidopsis thaliana
aacacacaagcaatgtcttaacaagtttggtacacaatgcctaaactagtatgtcaatgtgtgtgtgtttgc

SEQ ID NO: 2613 - DNA, 92 bp, Arabidopsis thaliana
tcatctggatgaaaatgagttttgatgttcgtttggtgccaaaaacggttcattcaaatgatccatccaaatgaatcatctggatgaatttg

SEQ ID NO: 2614 - DNA, 84 bp, Arabidopsis thaliana
cgagttctctagaccaaagaagggagtcaccggaggaagaagagtcaccgtcgtgatcatcatcatcgtcatcatctctgttca

SEQ ID NO: 2615 - DNA, 115 bp, Arabidopsis thaliana
agggctcatcagcaggagcttcaaaattctcaggcaaaggttggccacactcattgcatttgtgaacagctagctgcggaggagtttacacagaatcagaaaatttcatagatcg

SEQ ID NO: 2616 - DNA, 86 bp, Arabidopsis thaliana
acatttattggatatgtttgcatgtgtgtttgagtgtgtgaatttttcggatataaacctagctagatatgcatcaaagtatccat

SEQ ID NO: 2617 - DNA, 122 bp, Arabidopsis thaliana
attcactctcacaaggttcagtcttttttatgatctcttaatcacattggcaatgcatttgtgtgtttagtctctcacatggataagttatctggttgttgcaggatctgctgttctcatac

SEQ ID NO: 2618 - DNA, 108 bp, Arabidopsis thaliana
ctttattgccaactgatgaaattgaattagccattgtgttgtgtaacaaattgcagagcttggtgttgatgttgcagagctgggattatgtacacttcaagtgttgga

SEQ ID NO: 2619 - DNA, 89 bp, Arabidopsis thaliana
tttaggtgtgtgagagagagagagagtcacagcaaaagcatgccaaacagatttcaatctttcttctgccatcagtactctattctttc

SEQ ID NO: 2620 - DNA, 141 bp, Arabidopsis thaliana
cacacaaaaaaaatagatatatcgggatgacctaacaaaagaacctatatatgacagtagatttgtttggttttagaggaggaccttcttcatcttgatccattggatctgcttcttcttcttcttcatcagacgagctcc

SEQ ID NO: 2621 - DNA, 111 bp, Arabidopsis thaliana
tcataatacttctctctgtctgtctttgtccctctctctatctctctaattcatcatttacacaagtttctcttaattaagacgacttgagagagaaagaaagatacgtgg

SEQ ID NO: 2622 - DNA, 125 bp, Arabidopsis thaliana
gaagtatggctagtgttatagatgttactttttgtctgattattttgcaagaaaaaaaaaatgttggtttgagatatataatattagttggtctagtctgggacttgattagctgtgatgttcct

SEQ ID NO: 2623 - DNA, 78 bp, Arabidopsis thaliana
tctccttatgtgagagcaactgattggatgttgttttgtgaaacaataaatatatcatatggttggaatggctcttgt

SEQ ID NO: 2624 - DNA, 63 bp, Arabidopsis thaliana
caacgtcgccatgtcttcttcttctcctgaggatgaagactgtgttgtcgctctcaagttctt

SEQ ID NO: 2625 - DNA, 135 bp, Arabidopsis thaliana
gaagatctgtgatcgtaattgtgtttatttggctttgattggttttggttcatcatcagtgattatattgttgttagatttcgaggggaggcttcatttaaatctggatacacctattgttaagatgtttgattg

SEQ ID NO: 2626 - DNA, 80 bp, Arabidopsis thaliana
tgtttattttgtcatgtaggctcaccttgtatgaccacaccggttaaagactatatattagggagagacagagatagaga

SEQ ID NO: 2627 - DNA, 93 bp, Arabidopsis thaliana
aatcaccggagataaagataaaggaatggcgtccctgaaatttccgttggagattctcgccgtcttcgtcatcatctccgtgattcttttgcc

SEQ ID NO: 2628 - DNA, 131 bp, Arabidopsis thaliana
gatttatagtttcttatgtggttgtttggattgctaatgattggattcaccttgaattgcatgtgtttgatgttgagaaggtgattcattgttgttataggtgatacatcgattctttttgctgataaagt

SEQ ID NO: 2629 - DNA, 118 bp, Arabidopsis thaliana
tattggttactatattgaacccagagagatcatcatcatcaatcatcataactcaataatagttttttttttgttagtataatgtttctctctttcgttcgtgaccctttcatgtttt

SEQ ID NO: 2630 - DNA, 141 bp, Arabidopsis thaliana
ttgaaatggtttgaagataagaaacaaagaggcctttcggagatttctatgaaataaatctgtgtgtgttgcattttgaagcatttcctttttttgtcattgtgtgtgttttcagatgagttttatttcaatttctactta

SEQ ID NO: 2631 - DNA, 113 bp, Arabidopsis thaliana
tcaaatcgaacgatagtgtatactatagaggaagggaatgatttttcttatactcctaaatgatgatgatcattcttcatccaatttataggtataaactttaagttgataaa

SEQ ID NO: 2632 - DNA, 121 bp, Arabidopsis thaliana
agggtttttgtgttttgtcttttgtgtttgtgttgtggaatgagtgaagttatgtaatgaatatatataggaacttatgagattacgaagaatcaaagaaaatctctgaaatttacaaaaa

SEQ ID NO: 2633 - DNA, 103 bp, Arabidopsis thaliana
gaccttatgagcagtctattgaacaagcgtgtgatgcaggttcttcttctgtactccttatgaagaaagggttcttgcaacgaactttacaaccactgcagag

SEQ ID NO: 2634 - DNA, 79 bp, Arabidopsis thaliana
ttgtggcgcttgaaatgataccgttggtgacggttttgttgttggttggatcgttgacaggtgtcggagggttattatt

SEQ ID NO: 2635 - DNA, 134 bp, Arabidopsis thaliana
tgcaaacatggttcgtcttctcaatttctcgtttttctcccaattttggtttagtctgtgtctatgtctcttctgtttagttatatctggtcatggatattcaattatgggcgttttggttagtttcttaggac

SEQ ID NO: 2636 - DNA, 124 bp, Arabidopsis thaliana
ttctggattcttgctgtacaagcgagcacttggtggaatcacgatccactggtggtgaaatgttcttggttaagtggtacaagagaaccgctgagatcgtcaatggtgttgcgaaaatgggaac

SEQ ID NO: 2637 - DNA, 111 bp, Arabidopsis thaliana
tatgtaaaaattaaaaacaaattttgagagaaaacgaacatgatgatgatgagcgtgacagcaacatatcatcattattatgttattttaaaaattaatccaaagttttaa

SEQ ID NO: 2638 - DNA, 98 bp, Arabidopsis thaliana
taaaaacatctgtttcctctgaaatctgaataatgtcggaagccattgtgcttgtgagtattgtttgtttccctgtagcacagaaatataatattaaa

SEQ ID NO: 2639 - DNA, 72 bp, Arabidopsis thaliana
tataaggcggtcaaatacaataacatggaggatcttcacgtgttctcttggttgtcttggcttggcttaagc

SEQ ID NO: 2640 - DNA, 96 bp, Arabidopsis thaliana
agatacctgaaacacataaaaggtgatggctggttcaagattcatatgtatcttcaatgttctggactagccattgtcttcctaggcctcctcttc

SEQ ID NO: 2641 - DNA, 100 bp, Arabidopsis thaliana
gaaagaagagttaaaagtaaggaatctgattgttcttgatgggacttggtcgaaggctagaagaatataccttgagaatccatggctaaagcttttacgt

SEQ ID NO: 2642 - DNA, 139 bp, Arabidopsis thaliana
ggatctcttctgattctcgaatccctatttgtcttcgtcttcttttgttgtgaacttgcgatacatatatatatagatgcgagtacaccggactgtgaaattttggaacgaattgatttgatttgaatatggcaatcgc

SEQ ID NO: 2643 - DNA, 133 bp, Arabidopsis thaliana
tatcttcttgctcgtttctttccggtgcatttatgtatctaatattttcattgtatgtgcttattgttcttgcagaacctggcgatagagtagaagctgatgaggctattgcacaaattgaaactgacaaggt

SEQ ID NO: 2644 - DNA, 87 bp, Arabidopsis thaliana
accatctatcaatgttcatgtatgtgtgccgtgctgtgacatcaaacataattatcgcacattgaccatggatgctgcaagaaaata

SEQ ID NO: 2645 - DNA, 62 bp, Arabidopsis thaliana
tgaggttgttcttgtctgagtagaggaatctactctgtttcgcttagaatggggacaatcag

SEQ ID NO: 2646 - DNA, 99 bp, Arabidopsis thaliana
catctccagaggaaggtgatgattttgaagacgtggaatattttgagtccttcgttactttcttagtgtttttggtcattgctctggacctaggagaaa

SEQ ID NO: 2647 - DNA, 93 bp, Arabidopsis thaliana
ggacactgcacggtatgctcctcttcttgttcatggtcatgatccttatatgagcagggaaagtccagtttagacttgtagttagttactctt

SEQ ID NO: 2648 - DNA, 102 bp, Arabidopsis thaliana
tggattgagttattggattgattactaggtttctgattttgtttctgattagggtttagaaattcagaattgatcatcttctattgctcaattgaataagaa

SEQ ID NO: 2649 - DNA, 86 bp, Arabidopsis thaliana
ggcagaaggaaagagagcacactcccgacaagggcaaaactatctttttgctaatcccaggttgtgctctctttcttctgtcaaca

SEQ ID NO: 2650 - DNA, 81 bp, Arabidopsis thaliana
agcagtgccgtgattgatgatgggctaataaacaaggtataactctaacttgtttgatcttcttcctcatttggtaaagct

SEQ ID NO: 2651 - DNA, 89 bp, Arabidopsis thaliana
ggcatcaacattagccacgatatccaacatttgaagcattgcctatggcgagtgtttggttggttttgaaactgatgatgataaccaga

SEQ ID NO: 2652 - DNA, 115 bp, Arabidopsis thaliana
tatcattgtcccggagagagatcagatgacaaaattgcaacggaaacacaagagctgatgagtctctgtctctctccgagactttgattttgtttttgtttatgtttttatgtct

SEQ ID NO: 2653 - DNA, 95 bp, Arabidopsis thaliana
gtttaatggaagttgtttcatcatcatcatcatctctgtgattgtaattgatctcacaccatgtctgattacaatggtgatgatcttgaagatga

SEQ ID NO: 2654 - DNA, 90 bp, Arabidopsis thaliana
agaagccctagtcttattatcagctggtagatctgtttcagttttggtctgagcttggtttttgtgtggattctagcttcaaagtcgatg

SEQ ID NO: 2655 - DNA, 119 bp, Arabidopsis thaliana
tcttatgttttctctgtgcatgtgtctgagcgattgataattaaatgtccatgattgttttatagatatttatatgtccatgattgtttgtttcagtttacattatattgtttgcatat

SEQ ID NO: 2656 - DNA, 109 bp, Arabidopsis thaliana
tcaagttcaaggactttcttcttcttgtgagatcatttgttgcaatactgtggatagtttgatgtgagctctaccgaaacgacgaatggtctcgggataaagcaaggta

SEQ ID NO: 2657 - DNA, 84 bp, Arabidopsis thaliana
tgagagaggtaatgttgtagcggaactgaaagctgccaaagcaagcaaggaagcgatcactgctgctgttgctgaacttaaaat

SEQ ID NO: 2658 - DNA, 76 bp, Arabidopsis thaliana
attaagagagagagagtagagtactacactattggttcctgtgctgttgtgttttgtgcatctgttcttgtgtttc

SEQ ID NO: 2659 - DNA, 101 bp, Arabidopsis thaliana
cacctctctctctcatctctctctaatcttcatcgccgtatcctctgtcttgtgacagattgatttgtgtgatgtgaaactctctctccctctctttgcat

SEQ ID NO: 2660 - DNA, 100 bp, Arabidopsis thaliana
ttacagttatgtcagctggacatgctcttcatgtgtttgtcaatggtcagctttcaggtaatataagagaaacaatggaagcttgtctagtctctgtgtt

SEQ ID NO: 2661 - DNA, 90 bp, Arabidopsis thaliana
aatgtcaattgatattgttggtggtgatgcaactgattcagagaccacagatgagtttttgccattaaaataacgtatatgattgaagta

SEQ ID NO: 2662 - DNA, 89 bp, Arabidopsis thaliana
agaatcgaaaaagggtctctctgtgtgtgtgggggtactgactactgatgttgttggtttctgagattaagattagggagaagaagaaa

SEQ ID NO: 2663 - DNA, 134 bp, Arabidopsis thaliana
taattgtatattcgatcttgataataatttgtgtggtctcgtaaaaatgtgatgaacatttatgatgattgattattgggctagtgtaaatcaagaaacgggcgttctatcacgttgattatttcagtaatctg

SEQ ID NO: 2664 - DNA, 97 bp, Arabidopsis thaliana
aataatgttagcatggtgtgtcgttttgcatgtgtaagggaattgatcaaaatgttgactttctttcaaacatgtaagacgatcaaaatgttccaag

SEQ ID NO: 2665 - DNA, 125 bp, Arabidopsis thaliana
ccaaagggacagaaggatgtgttttgttgttgtgtataagtggtctcatctcatcttcttgattttgtcttcctctcaaagccattgttgctctttggtttctacttttatattatatctattta

SEQ ID NO: 2666 - DNA, 135 bp, Arabidopsis thaliana
gtagaatcttcaacaatgtagttaatgtatgtgagagtctttgagtgtgagattgggttttgcgtgagtgtgtgttgtaccactcaaatcagtttagtcaaagtcataaagcaaatttttagatacgtcatttgc

SEQ ID NO: 2667 - DNA, 122 bp, Arabidopsis thaliana
tagaagtaaaacaactgtcaagaattaagtttttcccacaaatctagatgaggaaaagagatgaatgtaggcattaacctcatcagcaaacttgatcaaaatagtagttcgaggacgttgtt

SEQ ID NO: 2668 - DNA, 133 bp, Arabidopsis thaliana
tacaatagaaatggcctttgcgcggtgggtttcatggacgatcattaccctgttcgaagtgctttctctcttctcaatcaggtaatatcattatgttgaaagtggttctcaatgcatcattcgtaagttttcc

SEQ ID NO: 2669 - DNA, 88 bp, Arabidopsis thaliana
catgatgtactcagagagagatagagagtccttgagtcaaatgtaaccatgtattctcgaaagccttgatgataacgtcatgatactc

SEQ ID NO: 2670 - DNA, 80 bp, Arabidopsis thaliana
ttggtctatgtctatatataatgtctgagagatttgggagagtttacaaattcctcagtttcatttggaatgcaccaaag

SEQ ID NO: 2671 - DNA, 73 bp, Arabidopsis thaliana
ggcaggagcagctccagcagcaggcgcagctccagcggcaggcgcagctccagcggcaggcgcagctccagcg

SEQ ID NO: 2672 - DNA, 131 bp, Arabidopsis thaliana
gagatcgagatttaataatggcgtaacgaattcagaacaagtacagagtctctctcaatcttttgtgtgttactattttcactataaaagtttctctctgtttttgttgtaactaaacacgtcattagata

SEQ ID NO: 2673 - DNA, 80 bp, Arabidopsis thaliana
aaaatctgccctctctctgtgacagggacagaaaaggaaacctatttctgccctctctcagtgacagagactgagctgat

SEQ ID NO: 2674 - DNA, 101 bp, Arabidopsis thaliana
agatttcaatggggctatatatacatattgctaaaagggatgttatggagatagtggagacatcatcatcatgatcatcatttatcaatgatcatcctcat

SEQ ID NO: 2675 - DNA, 76 bp, Arabidopsis thaliana
taattttcacgcgcccggtttagctgctggtttagctgctggtttagcggcaggtgcagcaggggcaggggcagcg

SEQ ID NO: 2676 - DNA, 88 bp, Arabidopsis thaliana
tttgctaccggcattggtgttggttttgaagtcgattttgctactgactttgatacttgttttgccaccggttttgctgtcagttttg

SEQ ID NO: 2677 - DNA, 68 bp, Arabidopsis thaliana
aaggaagagaagtgatgtgcatgaagagcttcaaagaactcagagcaattcatcttcatcttcctgtg

SEQ ID NO: 2678 - DNA, 137 bp, Arabidopsis thaliana
cagccagtagtcgcagatgcagcaccattaagattcacaagagatgtggttccctttgctttcgcctctcgatccgcagaaaagggttccttatcgagtgggaatcttgatgatgctgcatcagcaaatacatggct

SEQ ID NO: 2679 - DNA, 151 bp, Arabidopsis thaliana
ttttttattttatttccttgtatcaatgttgactttatgatttcttggccttgtaagggtatgtgtatatttgtatttacatatatatgcaaatttactttcctcttatgttctcaaccaattatgatgacctaataattccaaattgtat

SEQ ID NO: 2680 - DNA, 118 bp, Arabidopsis thaliana
aactaaatacctcagctcaactgttttgtttcagtacaccattttccttaagccttggaatttgttattgcattgaaacaacttaaaattaggagcttcgaggagtcatcaaaggatc

SEQ ID NO: 2681 - DNA, 210 bp, Arabidopsis thaliana
atagagtgattacacatacaagtggtcttgcttcttctatggttttaaaactgcaaataaagatttgcttcgcaggagagatagcgccatcacctcttctaagaagttaactagtggtgacggtatctctcctacgtagcaatccttatatatgcatcttaatacggagagatcaaggtatttcagttgttcaataatcaccctctaaca

SEQ ID NO: 2682 - DNA, 99 bp, Arabidopsis thaliana
tctcatcaatctccggcgtcggtaacggatcggaatccggattacctagatcggaaaaatctccttcttcatcgtcatcgtcgttgtacatatcgggat

SEQ ID NO: 2683 - DNA, 92 bp, Arabidopsis thaliana
tgaggccatgatcttttactttagtttgatatttctctggtgtagtcttttttttatttcttgataaagtattctggttctggtctttagtt

SEQ ID NO: 2684 - DNA, 98 bp, Arabidopsis thaliana
tagtttaagttttctgtgtgtgtatgtgtgactgtgtgaatagtcttaacttgcacaaatttgggggtttataaagtgcttcgttttcttttcttttt

SEQ ID NO: 2685 - DNA, 86 bp, Arabidopsis thaliana
ttaaagtgtcttttaagtcctgtgtgctttgtttctgcagatggcaactttggctagatatttcggactcgggaatcagacgcata

SEQ ID NO: 2686 - DNA, 141 bp, Arabidopsis thaliana
agagtcgcttgaagtcatagtctgattaacaacttcactatcagcaacttgataagtaattcttgatgatgatgcagcagcttcttgatcaacaggagctacgttattcacaacaactggattcattctgcactcttcaca

SEQ ID NO: 2687 - DNA, 137 bp, Arabidopsis thaliana
tgagcctttccgggatttggtgcgaggattttttttaacatattttgctccacgtttagctttcttccttggctgtgagcaacgtgtgtggaagagtgaaatggtttccaaacatgggagcgctagaactaacgatc

SEQ ID NO: 2688 - DNA, 102 bp, Arabidopsis thaliana
cgtggaggctgcagaaaaatgtttggcagagtacggtgttgatcgaccgggaatgggagatgtgttgtggaatcttgaatatgctttgcagcttcaagaagc

SEQ ID NO: 2689 - DNA, 88 bp, Arabidopsis thaliana
acgatggtgataatgaagttgatgatcgtttatcggagactatggaggttttcacggcgccttcctcttcatcatcatcaggaatctc

SEQ ID NO: 2690 - DNA, 88 bp, Arabidopsis thaliana
atggtattgcggcatgtagccaacagcttgagcatgtggttgcattgtgtattcaacagcttgagcatgtggttgcaaagcataccca

SEQ ID NO: 2691 - DNA, 93 bp, Arabidopsis thaliana
tgttgcaactgttgctgttgctgttggtgctgctgctgcaactgttgctgttgctgcacttgttgctgctgctgcagttgaacccgttgcaat

SEQ ID NO: 2692 - DNA, 82 bp, Arabidopsis thaliana
agagtaagtcggtgggtgatcggaggaattgaatgggttagggtgtggcagtttcttcttgtccatcaaattacggagacag

SEQ ID NO: 2693 - DNA, 150 bp, Arabidopsis thaliana
aagttacgataagcggagcagtaatagggcatctttctattggcaggcgacttggctatttgtatcttttgtgttcttgactattggctatgtcacttgccaaaggagagttgccctgtcactgcttccgcttaaacacagtctataacc

SEQ ID NO: 2694 - DNA, 129 bp, Arabidopsis thaliana
cgatttcttgaaatgatattgctgatctatacaacaagtgttttggggggaactggtttatctttggttctgtctgatagttaaggtgtttttgtgtgtgttaagatgcaacttcattgattctctgat

SEQ ID NO: 2695 - DNA, 135 bp, Arabidopsis thaliana
agttcattggtttgcctgcgattacagtgttgccttcagaaacgagaaagctcttagagaatatgtatacatatagagagacttgatggaaaacctttcgattgctgttcccatgtccactgccatatttttcaa

SEQ ID NO: 2696 - DNA, 77 bp, Arabidopsis thaliana
ggaggatgaacatcaggttgaaaattagtcagtgaagcagcagctcctgcaaatgttgattgatgttgctgatgtaa

SEQ ID NO: 2697 - DNA, 99 bp, Arabidopsis thaliana
aatggataaaaaatggagtgtggtgatgatgatgttcgttttggtagtgatggctgccagtggaggagaagcagcaagtcactcatgtacattaaaatg

SEQ ID NO: 2698 - DNA, 75 bp, Arabidopsis thaliana
ccagcaacatcagtctcaggttgttgacagaagctggtccagttttaataatggtctagtcggtaaccagaggca

SEQ ID NO: 2699 - DNA, 88 bp, Arabidopsis thaliana
acatttgaagctgttgctgttgttgctggaggaggtggtggtatgtcgctcctcctccggtgactattgatgcagatccagatggtgg

SEQ ID NO: 2700 - DNA, 74 bp, Arabidopsis thaliana
gtttgaatgcaaagaattgagctgcctggcttctagctgttgcttttgaagttgttgttgaatttgatattcat

SEQ ID NO: 2701 - DNA, 68 bp, Arabidopsis thaliana
atctttccttcttagctgttgctgctggtgcggttgagccatcccgcgctgctgctgcagcggaacac

SEQ ID NO: 2702 - DNA, 106 bp, Arabidopsis thaliana
tgatttgttccgtcttcttcgtgatcgtgtttgtgtctgtctctctcctagatttgggttttggggatttgggtatgcgttgttgtgatcagaagggacctttatc

SEQ ID NO: 2703 - DNA, 91 bp, Arabidopsis thaliana
tatatgtcgatgtgaaaatacagccatgctaggtgaaagaaaaaatgtgaatctcccaggtgttgttgttgatctccccacattgactgac

SEQ ID NO: 2704 - DNA, 131 bp, Arabidopsis thaliana
agcgatttagggtttagaggaatgttgtttggctcgaggtcatggagagtaattcgttaacccaactcaaaactctaaatgattctcggaccaggcttcattcccctcaacctattttatcgcatttttca

SEQ ID NO: 2705 - DNA, 106 bp, Arabidopsis thaliana
gacagaacattgttatcggatgaaagagatgagtctgagggcctgtgaaacagcaaatgagctatcgatcgatctatcgggtttgtatcagtttcgatatccatga

SEQ ID NO: 2706 - DNA, 75 bp, Arabidopsis thaliana
gagattatatatatagagagagtgtctgtgacggcgaagtgtttaattttcgtcagtcgctcgctgtgtttttgt

SEQ ID NO: 2707 - DNA, 60 bp, Arabidopsis thaliana
agtacaccgtgcacctcctccagctccagctcaggccagcggtggtggtggtggcatgtt

SEQ ID NO: 2708 - DNA, 99 bp, Arabidopsis thaliana
aagacggagtgaaaggaacttatcgagttgatgttgatgttcctgcaaatgagtggatcaacgtcactagcttctatgatgttctcatatttaactctg

SEQ ID NO: 2709 - DNA, 135 bp, Arabidopsis thaliana
aatcatgacggtgacaccacagaagctggttgagagactcaagtcacgtgctgggagatatattgcattgcacctgagatatgagaaagatatgttggctttcactggttgcacctatggtctcactgatgctga

SEQ ID NO: 2710 - DNA, 83 bp, Arabidopsis thaliana
gaagagaaagcagaatgagaaacttcaggttgttaggcatgaaggagatcctgattttgaagatggtgatgatgctgattttc

SEQ ID NO: 2711 - DNA, 77 bp, Arabidopsis thaliana
ttcttcgaggtcatcttcatcgtagtcctgtattggactaagtggttctaaatcttggacctccaccattttttttt

SEQ ID NO: 2712 - DNA, 140 bp, Arabidopsis thaliana
ttccgcgatattgcatcttcggggaatgatatcaggttgattacggtggaatcgggttcagatgatgatgatggtgttgagaatgagagggaattatgggggattgatctgaatgaagaagatgtatatgtgaatgatga

SEQ ID NO: 2713 - DNA, 97 bp, Arabidopsis thaliana
atatatgatttgtgagactaaaaagccgaaatcattatcggggtttattgtttcttctacttgtaatgatgttgatgattgatgtcttttagctcat

SEQ ID NO: 2714 - DNA, 66 bp, Arabidopsis thaliana
ttcttatagctgattgttgttgatgctttgttgcattttgtgttccaccatcagcagagcagttgt

SEQ ID NO: 2715 - DNA, 86 bp, Arabidopsis thaliana
aacatgcttcttcttcatcttcttgtccttgtggagacatgcgtcttgtacgagtccctggttaggaggaaaggaggcaatcaaat

SEQ ID NO: 2716 - DNA, 125 bp, Arabidopsis thaliana
ctgtgtggttcagtttctgccttgggatccagttactggttgttttattctcttttctgaatatatatgttcttagaagtaaatgtgacatttttttggaataaatttgtagcttgaatggatca

SEQ ID NO: 2717 - DNA, 83 bp, Arabidopsis thaliana
agaggtggcagatgagctgaagatggagctggtggtgatgagcatggaagccatccactctaagtacattgacgccaatctac

SEQ ID NO: 2718 - DNA, 136 bp, Arabidopsis thaliana
gagcgatagattgtgcaggtgccaatggagctgttggtggaggtaaacaatgatcagagggaggtggtgctggtgccagttgcggtggagatgatgggggtgggggggaagaagggggttgaggagggggagatgg

SEQ ID NO: 2719 - DNA, 107 bp, Arabidopsis thaliana
ctgtccggtttcatgctcagggagagaagactggcttcgtcgacgatatcgatctccacttgttcttcatcatcttctaattgtgcttgctcaacctccatttcgct

SEQ ID NO: 2720 - DNA, 88 bp, Arabidopsis thaliana
gaaacgaggaagcaacgtttcttgtgctataagtaaacataaaaggtattcgtttgatgttgcagatagggaacgcggtgatcaatga

SEQ ID NO: 2721 - DNA, 76 bp, Arabidopsis thaliana
agaagtggaggatagaagaagttgattttaatgtttggggtctctccgttgatcattttcttcctccggccaattt

SEQ ID NO: 2722 - DNA, 98 bp, Arabidopsis thaliana
accgttgcctagacgatttcatgactgacaatcttgatcttgacgatgacatggatgactttgactctgaatctgaaatcgacattgacagtagcgga

SEQ ID NO: 2723 - DNA, 89 bp, Arabidopsis thaliana
attccgttcaggtacgttactatatatataagaatctctaaattcgttgaattatccgaatctgtttgttcatggtgatgttgtgaacc

SEQ ID NO: 2724 - DNA, 134 bp, Arabidopsis thaliana
cttctcttgtcactcgcagtaatatatgtattcacagggtaataataacaatgcctcttctcatcatctgcttcgtttttatcgatacgtttgtttgagcagtggtatctttatgttgcagaacatgtcaccgc

SEQ ID NO: 2725 - DNA, 91 bp, Arabidopsis thaliana
tttacacatttttttaataatagtctttttattggttggtaacgtttgtgaagtgaccttagagagagagagtgtgtgtgtggtaaaatat

SEQ ID NO: 2726 - DNA, 168 bp, Arabidopsis thaliana
agcaagatggagaagcagggcacgtgcattactagctcatatatacactctcaccacaaatgcgtgtatatatgcggaattttgtgatatagatgtgtgtgtgtgttgagtgtgatgatatggatgagttagttcttcatgtgcccatcttcaccatcatgaccactc

SEQ ID NO: 2727 - DNA, 99 bp, Arabidopsis thaliana
acccattccctggtactgctgctgctgctgctgaggctgggctggtggcggttgaaccatcatgccttctccagccaccgtatagtacacaggcttccc

SEQ ID NO: 2728 - DNA, 85 bp, Arabidopsis thaliana
tcaagaaaatcatcgacgaacatcgagttagtaactctgagaagaaaagagacattggagattttgttgatgtcttattgtcttt

SEQ ID NO: 2729 - DNA, 89 bp, Arabidopsis thaliana
attgttttggggttttcatcaagctttgattttctgtttgtgcaggttgtatgtgaatttgactgggagtttgatgaacttcaggtgtg

SEQ ID NO: 2730 - DNA, 135 bp, Arabidopsis thaliana
agctagttttgaatcacttgagtacagataatcgttcctcagtgatcgagttatgctgttgtcttgttgtagtagttcatattgtctgctaaggttcagttttctctgttttataagtgagtccgtgtttggtca

SEQ ID NO: 2731 - DNA, 70 bp, Arabidopsis thaliana
tcagagatttctgacagtcgatgtactttattatggcgatgatgttgttgatgacagagagcttctgacg

SEQ ID NO: 2732 - DNA, 126 bp, Arabidopsis thaliana
aaatcttgactgttcgaaatattaacagctaatctcttgttctgtacttcaacaatccatgttgtgataggaaactttcaaagcatcagtaagagaagcaatgttttagacatttcagatttatgg

SEQ ID NO: 2733 - DNA, 103 bp, Arabidopsis thaliana
tgacaaaaagagagtgagcacgcaaaagcaaccatatacaaaacttttatacaacttcccctttgtgtgctcactctcttctgtcaacttcttttcccccatc

SEQ ID NO: 2734 - DNA, 128 bp, Arabidopsis thaliana
gaggaaagctagctaatacttcttacctggtatctgttcctttcagccaatggaaatatatgttgatgatgaagccaagttgactcttcatggacttgtccaggtacgtttaactggtttgaggtctt

SEQ ID NO: 2735 - DNA, 111 bp, Arabidopsis thaliana
tcgattttgtttgctttctattgtctgttgtttcgtaattaccgattcatgtttgaactttgtggttgatgacattgatgttgacaaagtatcatcttgatcgttgtttta

SEQ ID NO: 2736 - DNA, 141 bp, Arabidopsis thaliana
ggagaagaaagcagacaatgagaagtcttacgtatatatctgtgcaagtcttgtgaggtactcttctctctctctctcctcaaaatcagcgaagcagtgagcttctcagtctctctctatctatcggattcacgttttaag

SEQ ID NO: 2737 - DNA, 137 bp, Arabidopsis thaliana
catgaacaatgtataaatatgtatgtgcatcttttatgaattatccctggctggatcaattttttttctctgtttctttttaatggatcaattggagtgaatttatgtagattctgtgttcaatatatatatacata

SEQ ID NO: 2738 - DNA, 78 bp, Arabidopsis thaliana
ctggtttgctttcatcatcgctcactagggagactgtgtgggactttcaagtgaagtggagtgaagtgaagggaagcg

SEQ ID NO: 2739 - DNA, 93 bp, Arabidopsis thaliana
gaagattgcgtttcagagtggtgaggtgtttttgcatatagcaattatctttgtgtatgaatatcttgatgttgaaagaatgtgattatgact

SEQ ID NO: 2740 - DNA, 77 bp, Arabidopsis thaliana
ataaagtattgcatggatgtacatatgtggctgtgtattgtttgcgtcagcttggacaagttgctcttgctttgtgt

SEQ ID NO: 2741 - DNA, 96 bp, Arabidopsis thaliana
ggtatgggaagattcttcaagttcttgctttaagttgtgtttttgtaaaatgcttaaacgttttgcaggaactgcgaagaagctaacacctatgca

SEQ ID NO: 2742 - DNA, 93 bp, Arabidopsis thaliana
ttgttagaagggattgtgagctatattagcatgtactgtgtcgatgaacctggaaatgaagatgatgatgtgttgatggtctctgggtttagt

SEQ ID NO: 2743 - DNA, 98 bp, Arabidopsis thaliana
gacttctgctagaactagaaatgaatcagagtttgttgtggtttagaaggtagagatgacaaagtgcttcgattcatgggtcttggtgtttcatcatt

SEQ ID NO: 2744 - DNA, 99 bp, Arabidopsis thaliana
agaagagatgctcaatcctgtggttctgactgctttgttgatttgtatttcaatgaaagattcaccattgttgctgctatccttcgacgcttcattcat

SEQ ID NO: 2745 - DNA, 124 bp, Arabidopsis thaliana
tatcagccgtccgatctttgactctgatgtttcctcttcatcgaacgacaggctcgtcgaggcggtggaggaggagactgttgatggtgctggaggaggaagaggaggaggaggaggaggatga

SEQ ID NO: 2746 - DNA, 245 bp, Arabidopsis thaliana
ggaggacgactagctacggtttcgagcctggtcacatgcgtagagtgtgaaaggtaattaggaggtgacagaagagagtgagcacacatggtggtttcttgcatgcttttttgattagggtttcatgcttgaagctatgtgtgcttactctctctctgtcaccccttctctctctctctcttttcaattacaaggttaattataactagtaaaaggtctctgatttggtatgatatagttaaggt

SEQ ID NO: 2747 - DNA, 70 bp, Arabidopsis thaliana
atgatgatgatgttgcaagtgattcgagttcagatctgtttgagcttgatttagttggaaatcatcatca

SEQ ID NO: 2748 - DNA, 97 bp, Arabidopsis thaliana
agaatatgaagttcagcagttaatggaagctgtgagtccttcttgtacttgcaagagatttagctttagtcaaatgccgagcaacagagtagggagg

SEQ ID NO: 2749 - DNA, 103 bp, Arabidopsis thaliana
tcgtcaggattgtatgtgagagagaatttggcgtagacgtcttggttatcgtagatgcagatgttgttgatgtttcttgcgttgtgaacatacacttggagaa

SEQ ID NO: 2750 - DNA, 91 bp, Arabidopsis thaliana
cttttaagaaggcgtccaaagagacaagatggtttgtgataggagatgatgatactctcttcttcttggacaatttggtgaaagctctcga

SEQ ID NO: 2751 - DNA, 138 bp, Arabidopsis thaliana
ttccacaaagttcaattacactgtttatccctgtatctttctggttgatgcaactcctagctgtgtgtggatttgaatttgcaggtgggtggtagtgaggtatcagatgaagaaagaaaagcaagaatggattcagtg

SEQ ID NO: 2752 - DNA, 133 bp, Arabidopsis thaliana
agagattgatcctgtgatgatgatggagactgctatttctaaagatgagtataagtcgcttgttgttgttgattaagaagctttactgtttttttgagtttggttttgtattcctgtttcatggttgaagctt

SEQ ID NO: 2753 - DNA, 93 bp, Arabidopsis thaliana
aattttatcaaaagtttatggctaattaattttgatgttcctggatttggtagggacgggaagatgactgttcgactgttgatgaaatatttg

SEQ ID NO: 2754 - DNA, 61 bp, Arabidopsis thaliana
aaagtcttgtacatatatacacacacacctattattctcttggtgtgtttgtgtgttacat

SEQ ID NO: 2755 - DNA, 114 bp, Arabidopsis thaliana
caacggctgcctactgatgttgctgattgttgtttggtggagggccaggaggtaaaggtggctgctgctgctgcacgaaataaaatatagacaacggattagtcaacggattat

SEQ ID NO: 2756 - DNA, 107 bp, Arabidopsis thaliana
ggctgttggtcaagctgccatctctcagtcacctaatgatgatgatggaggcccaaacgaaagtcgtcctggtgtacttaggcatggtggccatcttgtgatcaagc

SEQ ID NO: 2757 - DNA, 86 bp, Arabidopsis thaliana
ggaggaaactttcacggctgcaaaactatctgatgccattcttcttggagctattggagggtatgtgtgtgagtgctgtttcttta

SEQ ID NO: 2758 - DNA, 72 bp, Arabidopsis thaliana
atattggctttgattctttctcagagatttgggttttgagtccggagcttgatgaagaagaagaaggccatt

SEQ ID NO: 2759 - DNA, 134 bp, Arabidopsis thaliana
aggtagtggatctcgacagggttgatatgagaacacacgagtaatcaacggctgtaatgacgctacgtcattgttacagctctcgttttcatgtgttctcaggtcacccctgctgagctctttctctaccgtcc

SEQ ID NO: 2760 - DNA, 127 bp, Arabidopsis thaliana
gtagtggatctcgacagggttgatatgagaacacacgagcaatcaacggctataacgacgctacgtcattgttacagctctcgtttcatgtgttctcaggtcacccctgctgagctctttctctacc

SEQ ID NO: 2761 - DNA, 82 bp, Arabidopsis thaliana
ggaaagctgtagtgaagcatgaatctcttcttcggggggccaacaagagaatccaagctttgtgcttctgctggggctccaa

SEQ ID NO: 2762 - DNA, 87 bp, Arabidopsis thaliana
ataataacagagaatgcatgttcatatatacctgtagctagatattctggagcagcgtatccctgagttcccatgactctggtagaa

SEQ ID NO: 2763 - DNA, 90 bp, Arabidopsis thaliana
ttggagaaggaggagaaggtgtcgctgtcgcagaggagcaaccgcaagagactgtctctgttcctgtctctccttcagacatgctcacca

SEQ ID NO: 2764 - DNA, 119 bp, Arabidopsis thaliana
tgatatcgtttcaggtcttgatagcttgatgagtcttaacactaagttatttgaacatttgtttgatgatgatgatggtgatagacatgagcatcatcctgaagtggtaatggatgaca

SEQ ID NO: 2765 - DNA, 123 bp, Arabidopsis thaliana
tggattttgttttctcgactgatttggggaaaagctatggtggtctgattaatctctgtctgtctttggtgagatgggtttggatgctgttaaagctaaagggaattggaaatcggagaaacc

SEQ ID NO: 2766 - DNA, 70 bp, Arabidopsis thaliana
caaatgctagcaaaaatcaggacatactaattcgtatgagaagttgatgttctttttggttccatttgtg

SEQ ID NO: 2767 - DNA, 92 bp, Arabidopsis thaliana
tgtatattatatacctcagcatgtagtttcttgttgtgggcaagaagagaatcattgtccgatttcaaaacatcgaactgttttttgagaga

SEQ ID NO: 2768 - DNA, 94 bp, Arabidopsis thaliana
ggttgggatgttggagagagggaaagacaaagctgatgatgatgatgccattttcatcaaagttaagatatttgttcttcttcgagattatgcg

SEQ ID NO: 2769 - DNA, 88 bp, Arabidopsis thaliana
cagaatttggttactatcaaacgaaacgttgttttccatcattgggaaagtttcaagaattttgttgatggattattagctgaacctg

SEQ ID NO: 2770 - DNA, 110 bp, Arabidopsis thaliana
tggcgttgttgttattagtccgaactttgtttattgttgtttcgatccagtttttgtgattctgtgattggtttcttcggtggatttatcgacatgaaatggatatcgct

SEQ ID NO: 2771 - DNA, 194 bp, Arabidopsis thaliana
cctttaatctcagctcgtcagacaaaatcgatctgggatgaatttggatctaattgagcaaaaaattgtgttttttcaatctattgaatttcacatccttaaacccttgcatattcaatctattgaatttcgcatatttttcctcaaatttatccaaaatcatcccaaatctattgtgacgggttgaaagtaag

SEQ ID NO: 2772 - DNA, 82 bp, Arabidopsis thaliana
ggtgaaatttctatgtgctatagatcaactgttggcagtggatcagtggatttgtgtgtatgatgaaagaattcaccctgct

SEQ ID NO: 2773 - DNA, 102 bp, Arabidopsis thaliana
ggaagctgagtacatcttgttttctgctcattcctctgtttcaacaatggagagtactattgttatgatgatgatgataacaagatctttcttttgcttctt

SEQ ID NO: 2774 - DNA, 111 bp, Arabidopsis thaliana
attgatcaatttacatagtttcttgtctgttcttgttgtagttgtaagcgtaggtgcggctctcttcttgtttcaacagttagccgggataaacgcagttgtgtattactc

SEQ ID NO: 2775 - DNA, 126 bp, Arabidopsis thaliana
gcaatgtcataggtgagtttccggtaatgtaaggttgtccagtgtaaatgacttggatatgttgttgttgagcttggttcataaatggtggatacccggaaattgggactggaactggtctgttta

SEQ ID NO: 2776 - DNA, 90 bp, Arabidopsis thaliana
tctttccatgacttgttcttgttcttcttcaactacttcgatctctaagttttcgctctccgaaatggttcttgaggaagtgtaagggaa

SEQ ID NO: 2777 - DNA, 87 bp, Arabidopsis thaliana
aagtccaagtatgttgttgttattgctgttatgatcatgtccggggattaaccctgcgttgtaagaagacagcaacgagcttagaga

SEQ ID NO: 2778 - DNA, 77 bp, Arabidopsis thaliana
ctcttagagtgagagaattatggtgtgttcttaatgcttaataatcaccgacacagccattgttcttcatcatctcc

SEQ ID NO: 2779 - DNA, 106 bp, Arabidopsis thaliana
cttcatacaaaacagaaaccaattacattcttgttgttgttgcagtgctcagagaacccaatgaacatcatgaagtaccaaaacgacaaagaggtaataatactgc

SEQ ID NO: 2780 - DNA, 125 bp, Arabidopsis thaliana
aagattgattgataacgttctagaggacaggggatgtggtaatgttgatgatgatgaaatgaatgattcagactgggaagactgtccaatccctagtcttgatagtacggttgatgataataatg

SEQ ID NO: 2781 - DNA, 125 bp, Arabidopsis thaliana
gagtatttcaatagaatgaaaactgtttttggggttagtcctggtccggagcattatgcatgtttggttgacttgttaggtcgtgctggccggttgaatgcagctttgcgtctcattgaagaaat

SEQ ID NO: 2782 - DNA, 76 bp, Arabidopsis thaliana
tttagagaaaacagagtctaagttcccaaacacaacgccttcttgtgtgtctttgactctgatcttctccattcct

SEQ ID NO: 2783 - DNA, 109 bp, Arabidopsis thaliana
tcttaataaagcaattattagattattttttcaaccaaaaaaataaaaattattgatttgtcataagatttgattggttgaatgatttattttaagactttagagggaa

SEQ ID NO: 2784 - DNA, 83 bp, Arabidopsis thaliana
ctgctgaatctgctgttgttgctgatgctgagcatagtaataatgatttcttgcgttgtaagcaatctcagcagcagtaaagg

SEQ ID NO: 2785 - DNA, 98 bp, Arabidopsis thaliana
agagaaagagaaagaggaagaagaagagggagagagaggagatggtgtggtgaagtgtcactctctctttctctccttatctttgggctctttgtgat

SEQ ID NO: 2786 - DNA, 79 bp, Arabidopsis thaliana
attatgggatcctgaagacatatgtcatttgctgtcagaaaattctgtaagttagagtgcatgtgcttctcttctcgtt

SEQ ID NO: 2787 - DNA, 137 bp, Arabidopsis thaliana
ctctgaagtagatgtggtctcattaacttagatctgtttgttcttggtaaaattttgctctgtttttttttggtttttcttcgcttctgatttcttgctaggtttgtgtgtgaaatgatcggaccaaatcaattcat

SEQ ID NO: 2788 - DNA, 136 bp, Arabidopsis thaliana
gtgtccgttgttcctacgaagtcagtattccttctcaagtgtcttttttccttctatgagagtgttgttgttcttggaattcaatgtaacatcaatagatgaaatcttactcactttacctgtattgtttttcaaa

SEQ ID NO: 2789 - DNA, 146 bp, Arabidopsis thaliana
gattatgtttttcttgtggtatgttttgttgttttgttgtttttagttgtagttttcagtcttactctcttctttgtttgattgtttccctattaatcgctgatgcaattcaaaaatggtataaatatttaacgttataaattaat

SEQ ID NO: 2790 - DNA, 108 bp, Arabidopsis thaliana
atgagagggaaagtgcgagaaagtgaagatcctagtgtgaggccattgtagcaactcgtttgatcttcttcttcatcctcagaacacagataatataatttccaaaac

SEQ ID NO: 2791 - DNA, 102 bp, Arabidopsis thaliana
attagcttacagagagcttggatttagatttggctctgatgtaatctccggtgaatcgagaaatagggttagtttctgcaaccaaagctctaaatggaaaga

SEQ ID NO: 2792 - DNA, 92 bp, Arabidopsis thaliana
ctgctggagtacgaatccgttcatgatgatgatgatgatgacgatgaaaatgggaataggttgttcagggcatgtacggagtatacttataa

SEQ ID NO: 2793 - DNA, 93 bp, Arabidopsis thaliana
ggacaagaagttactgcttgctcttctttgacttgctgttgcagggattttggggagagacagagcacctttagtggcctcttgttagatatt

SEQ ID NO: 2794 - DNA, 110 bp, Arabidopsis thaliana
tcgaacgaaactgggattattgttaatatgtgtgaggaattgttggctgattgataaaagaactgatggattcggacaaaatgttgataagagtttgttgtttgttatgt

SEQ ID NO: 2795 - DNA, 122 bp, Arabidopsis thaliana
atgtatctgtgtatgtgagagatctagttagtgtgcgtctgattctgttctgtattcttgtgttgttctgtaatgagaaggagtttcatgggtggttaagcgcatgcaaatttggatgtttt

SEQ ID NO: 2796 - DNA, 98 bp, Arabidopsis thaliana
gacgaagagcaagaggatcagtatgtgggaacttatgtgaaaaaggaataggcttcttcttcctcatgctgctcaagtatcttcgagctttctcgttc

SEQ ID NO: 2797 - DNA, 91 bp, Arabidopsis thaliana
gagggatttttcctgagggatgatgatgatcttcatcttcggtgctgtgatcggaggagaagaagatgattagaggagggaggagagagga

SEQ ID NO: 2798 - DNA, 78 bp, Arabidopsis thaliana
aataacattattatcaccagagtttttggttccaaatcaccagatgagcctggtgatgtgtgtgtgagatacttccat

SEQ ID NO: 2799 - DNA, 83 bp, Arabidopsis thaliana
caaaccaaaacgaagcaaaattgaagaagatgacgaagacaatgataatgagtcttcttcttcttcaaccacagtttcgtctc

SEQ ID NO: 2800 - DNA, 67 bp, Arabidopsis thaliana
catctagcgttcgacggaataaccagagagagctttctgcgacggctttaatggtgttgatgctggt

SEQ ID NO: 2801 - DNA, 76 bp, Arabidopsis thaliana
attgatcctcatttacactgacacttttgagtgttgtgcttctgtacttattccctagaatgttctgtagatggga

SEQ ID NO: 2802 - DNA, 69 bp, Arabidopsis thaliana; identical to SEQ ID NO: 1050

SEQ ID NO: 2803 - DNA, 72 bp, Arabidopsis thaliana
tgaaggtggagacgatgaagaagatgaaggtgaagactattgacaccttttctcaagcaatgtgctaccaaa

SEQ ID NO: 2804 - DNA, 83 bp, Arabidopsis thaliana
gattatagtctgacacgtgtgaggacgagactcttctgaatcatcgttgctcatttctcactctgtgtgggagcctaaacaat

SEQ ID NO: 2805 - DNA, 115 bp, Arabidopsis thaliana
tttgacagcttctcaaaccgggatttcccaaggatacggattgtaggcaactggtcatactcatcttcctcctctaaatccaaattcagaagcttatctatctctttctctgttt

SEQ ID NO: 2806 - DNA, 130 bp, Arabidopsis thaliana
aaagtttggcgacgatgctatatgtttcagtgatcatgcaatcgattcttatatgggttttgtctgtgttcatgggtggttatccggctgttgtgtcgctgattttgtcgtgtttgagtattatcctctc

SEQ ID NO: 2807 - DNA, 79 bp, Arabidopsis thaliana
tgttgcaactgctggctttgcaattgatggtgtggtaactgagactgcggcgaaagaaattgctgctgctgttgctgtt

SEQ ID NO: 2808 - DNA, 115 bp, Arabidopsis thaliana
agttgttgttgttgttgctgctggagcaattgttgttgttgctgagactgcgattgattgttgttgctgtgttgttgagactgcaattgttgttgctgctgcagcaactgttgtt

SEQ ID NO: 2809 - DNA, 81 bp, Arabidopsis thaliana
agaagaagaaaaaaaaaactccgatgacggaagagatgagtaaagagtctcctcctcctcctccgacgtcgttttcttcgt

SEQ ID NO: 2810 - DNA, 122 bp, Arabidopsis thaliana
cagaaattgaacctgaagctgttcgacagggaaaggtccgtgctgggtttcttcatcgtcttgttgttggacagcattctggtttctacgctgctccatcgtcgtcatttctctcaatcaga

SEQ ID NO: 2811 - DNA, 65 bp, Arabidopsis thaliana
taaagctgcttgttgctgatgaatgatgatgctttgctttatctttattagtggagcctttaaat

SEQ ID NO: 2812 - DNA, 76 bp, Arabidopsis thaliana
agataacttttcttcttcgaattgctttcacattatcataattgcaaatggagaagagagagagaggagaagacag

SEQ ID NO: 2813 - DNA, 77 bp, Arabidopsis thaliana
aggcgaagaacaatctgaaagagattccatcttctaaaggtggagcaattttgttggcttgttctctcaatctaatg

SEQ ID NO: 2814 - DNA, 82 bp, Arabidopsis thaliana
tctcttctttagtgagttcgttacgacgaaggaataatgaatgtagttgtgtccaccaccgtgatggaggaggaggatcagt

SEQ ID NO: 2815 - DNA, 129 bp, Arabidopsis thaliana
agatgaaagacagagcaatgtgagcaagagacagctagtgtgtcagaagaagatgcatatatcaataaatgtattgtctattaaattcttatttacacatattttttgaggcccacattactttcttat

SEQ ID NO: 2816 - DNA, 141 bp, Arabidopsis thaliana
ccagtttttcttcagacgtcaatgggataagatcagagattatgatgaagcaagaagagataatgatgatgatgatgatagaccaccacattgaccagaggacaaaagggtacaatggggaattcacacaagggtattata

SEQ ID NO: 2817 - DNA, 123 bp, Arabidopsis thaliana
accacacaatagagctgttgctagaagaattcagaacatgggatggagagctgatggtggtctttggcttcttgttcgtggtggaggactttatcttagcaaaggtactggggtaagtacagc

SEQ ID NO: 2818 - DNA, 142 bp, Arabidopsis thaliana
cgttttttctgcagcaatgcaacgtttcagctgccagggtttttttcatctcataattttgaagatgatgaagaagatgacgatcttccaacatcacaaaaagaaaaaagcacatctgcgggggaacgtgtcagtgctttag

SEQ ID NO: 2819 - DNA, 138 bp, Arabidopsis thaliana
aaaagaagttgggttattttggtggatgactttcttttgagtgtaaatcaggaaaataacatgtaaatatatgtgtctctgattcacgatacaagagtcatgtaatgctaaagaactaaagcaagaaagttatacaat

SEQ ID NO: 2820 - DNA, 129 bp, Arabidopsis thaliana
gatggagatgggctgtaaacgtcggagatggagaatgaagggctaatctcctcaattgatttgatcatttttttgagtgatatccttgggtttcctataaattatcttcttagggtttagtattgttcc

SEQ ID NO: 2821 - DNA, 139 bp, Arabidopsis thaliana
tctgctccgaacagaacaggttaacttcttcttctttcttgaattagggtttcagagatctatacatacatgtgtatgtatccatctaattaatgaggaaatgagctagatatatgactcgtgcttgagaacagacagt

SEQ ID NO: 2822 - DNA, 135 bp, Arabidopsis thaliana
gttgtgtatgactagtgttggattactgtttgattggagaattagggtttcaagattttttttgttcatgaatctaaattcgaccgatgttttttctccaggatatgtggttttatctatcagagcaggagaagt

SEQ ID NO: 2823 - DNA, 118 bp, Arabidopsis thaliana
cggtgtctgcattgagttctggaaaatagggaaagccatgcgcatagaggtacttataagttcttatatatacatttctaatgttgttgctttgcatgtagacctcagtaaacattta

SEQ ID NO: 2824 - DNA, 129 bp, Arabidopsis thaliana
aaatctcggacatgcggcttgagattagcccaaacaaaaacaatagctcattaattggatcttgttgttggttcaaactcatgtgttgttaattagttttttttttctcttattgcaataatggtctgg

SEQ ID NO: 2825 - DNA, 94 bp, Arabidopsis thaliana
ccatgcctttgcgatcagcttgctcttcttcatcatgtttatgagagagatgagaaagagaaagagagagacgtttttggggtttagtactagt

SEQ ID NO: 2826 - DNA, 87 bp, Arabidopsis thaliana
tattgcagaagaaaatccgaagttggacgcgaccatggcttcttcttagaggtttcagctttgtgtgcttgctcgtctgtctcttgt

SEQ ID NO: 2827 - DNA, 140 bp, Arabidopsis thaliana
atacacgtatccgccttatggtattgagatgattcatgaggatgatgaagtagcagtagctcatcatcatcatcatcaccagagcggtgagtattacagagagtatgaagatcatcgtagtagcgatgtagataacgatg

SEQ ID NO: 2828 - DNA, 82 bp, Arabidopsis thaliana
aagggatgggttggctgtgttggatagttgaaagttcaagagctttaattctcttccaaggatatatatagctgaattctcc

SEQ ID NO: 2829 - DNA, 198 bp, Arabidopsis thaliana
acattcttgcccaacggagtagaattgcatgaagtggagtagagtataatgcagccaaggatgacttgccggaacgttgttaaccatgcatatgaataatgtgatgattaattatgtgatgaacatatttctggcaagttgtccttcggctacattttgctctcttcttctcatgcaaactttccttgggatattcta

SEQ ID NO: 2830 - DNA, 84 bp, Arabidopsis thaliana
gccattgaggctgaagaggatgttgttgtgagtgatggccttttgaagacatctaagcttagagaagatctctttgcctttgga

SEQ ID NO: 2831 - DNA, 105 bp, Arabidopsis thaliana
taacactttggcagaaagtataatttctacagaaggcaatgttaaggtagcaaatttttatgctttctttgcattttcttgattcgtatatgttttggtttagaa

SEQ ID NO: 2832 - DNA, 134 bp, Arabidopsis thaliana
gtccattaactaggagtacccttcaagcctttgtttccttaaagaaatttctgattcgtatgttgactgaagagatctggtgcaaagtggcagtgggaggtaggtctatcctctttggacacttacccatctct

SEQ ID NO: 2833 - DNA, 90 bp, Arabidopsis thaliana
cctttctttttgttaggttactacgtgatgaactgatgataggctacgaattttgttagctattgttgttctttttcttacgagtaatta

SEQ ID NO: 2834 - DNA, 93 bp, Arabidopsis thaliana
atattggcgatgcacgaggccagccgcgagtgtgtgtggttgaggtcaatgactcaacacatacgagccgattgtggaatggtcgaagccaag

SEQ ID NO: 2835 - DNA, 113 bp, Arabidopsis thaliana
ggtgttgtgtaaatgatcatcatcatcatcatcatcattatccaatatcataattatcaatatggtgatgatgatgatgatgaggattgtgtgtgaatggagcgatgaagatt

SEQ ID NO: 2836 - DNA, 145 bp, Arabidopsis thaliana
gtacttttgttgttgtcggatacatgtgcttaagatacatgagcgttcatgaaaatgactctctctttctatgtgcatgtgcatgagaggcatgtgaccaccgcaaactaagccttaactgatatctttttctttaactaatcat

SEQ ID NO: 2837 - DNA, 242 bp, Arabidopsis thaliana
catgcgttccggaacctatagaatctcgttggttttgtgttaagtcttttcttggagaaatgtcttggttaaattcaatatatatagtccaatctattgaagtactagtacaccagctctaataagctgatgtgggtaagtagttcaatagattggactatgtatattaaatttgactaagagataaactagagaatgggaataaagaatgagaaacggtattagaaagttctttgaggaaa

SEQ ID NO: 2838 - DNA, 142 bp, Arabidopsis thaliana
aaacaaaaatctctttttacaagtactatacatcaatgtgttgtattgttgatcgattagtacttgttttttttttcctttttaaaaggaagaaccggacgatatagaatatgacttaacacaataacacaaactcatcaac

SEQ ID NO: 2839 - DNA, 159 bp, Arabidopsis thaliana
ggaattgatggtgacagaagagagtgagcacacatggtggctttcttgcatatttgaaggttccatgcttgaagctatgtgtgctcactctctatccgtcacccccttctctccctctccctctctctctctctctctacagcatttcatttagttttt

SEQ ID NO: 2840 - DNA, 66 bp, Arabidopsis thaliana
taaagatttgtgtctgcttcttctctcgctcttctttacaagacagagaaacacagacacaaacaa

SEQ ID NO: 2841 - DNA, 133 bp, Arabidopsis thaliana
ttagagtcatagaagaggtaggatttggtgaattgtcaagggtgggagggtgggttcttttcatcatcctcttgttcttctcaagaaccatcttagctttacccaactccttctttttagtactttcttcttg

SEQ ID NO: 2842 - DNA, 112 bp, Arabidopsis thaliana
accttcgctttcattgtccttgttgaggttctttgttattgtgttgaatgaagttgttcaatggttttgcagaactatgatccagaatatgattaaagaggggaagattgta

SEQ ID NO: 2843 - DNA, 129 bp, Arabidopsis thaliana
tcttgatgctacgtatcatgtgaagcgttagagttttaaaagtgattccactaagtctttatatatgttagacattggtgtacttaaagactccatcaggttttgatgcgtgatttcgagtcagtttct

SEQ ID NO: 2844 - DNA, 83 bp, Arabidopsis thaliana
aaaacaactggtatatatatatgtagctcgtagagtgtgattttagaatgtgagctacgttaagcatagccaaacttgttacg

SEQ ID NO: 2845 - DNA, 61 bp, Arabidopsis thaliana
ctaagcatgtgttagtgtcagtatatgtgtgtatacatacattgatgtactgtatcatgta

SEQ ID NO: 2846 - DNA, 103 bp, Arabidopsis thaliana
atttatctaatttctacctcgtgatttgtaaacagttggtgctgctgctgtggtcgttgggctggctgcataccgtgtgtatgccacaagaaagagctcgtct

SEQ ID NO: 2847 - DNA, 80 bp, Arabidopsis thaliana
gggttctcctccaactccaaggtctgatcatgctgctgcagtgcacgctgagcgttaccttctaatctttggtggaggat

SEQ ID NO: 2848 - DNA, 119 bp, Arabidopsis thaliana
caacgacacgtcctgatcctctgcctcatacttcttgctgtacttcttcagggtctttgctatctcttcttccttctctgcagtcaagaatgatggaggtcttggacgccaagccaact

SEQ ID NO: 2849 - DNA, 68 bp, Arabidopsis thaliana
gaggtggtggctgttgttgctgaggtagaacattttcttgtggttgctgagctgctgcagctgctgct

SEQ ID NO: 2850 - DNA, 96 bp, Arabidopsis thaliana
cggaggagaattcattgtcttcttcttcatttgtatctaaaccattccatgaggagaagtaagaagaagaagaagatggagatggtgaaggtaaag

SEQ ID NO: 2851 - DNA, 90 bp, Arabidopsis thaliana
cccctgacgaaactgaacccggtttgtacgtacggaccgcatcgttggaatccaagagaaccggatttgtacgtacactgttcatcgacg

SEQ ID NO: 2852 - DNA, 89 bp, Arabidopsis thaliana
tatctccgagattgagtttcttgatgttgctggagatatctggaaaagttctcaattccgagcaaccagtcatgtcgagtctctcaaga

SEQ ID NO: 2853 - DNA, 127 bp, Arabidopsis thaliana
tatatagaggagaagaaggaatatcatgaagagaattgaagatgattcttatgcaagtatttgttattgttatcatattgttatttagctctctttttttcatatccccaactctctaaaagatata

SEQ ID NO: 2854 - DNA, 236 bp, Arabidopsis thaliana
ttatagatgttgagttggtggaggaagagagctttcttcggtccactcatggagtaatatgtgagatttaattgactctcgactcattcatccaaataccaaatgaaagaatttgttctcatatggtaaatgaatgaatgatgcgagagacaaattgagtcttcacttctctatgcttggactgaagggagctccctatttttatctttctcagagtaccacattttatatctata

SEQ ID NO: 2855 - DNA, 96 bp, Arabidopsis thaliana
ggtacataatttagctgcaataaaagaatggctgcaagatcaaagagtgcttatcattcttgatgatgtagatgatctagagcaattagaggtatt

SEQ ID NO: 2856 - DNA, 121 bp, Arabidopsis thaliana
ctcctcttgtagagaaccaccgctaaggtcggagtctctttgtgagctgatgctatttctgattgatttatcaatggttcgtgtgagaggattgggtgatggccttggtggtatcgtctcc

SEQ ID NO: 2857 - DNA, 94 bp, Arabidopsis thaliana
atctgaaactgatgatgattatgatgctgatgattgttattgttgttgttttggtggtgactattcatcatcatcatcatcatctgcgtgtgtt

SEQ ID NO: 2858 - DNA, 117 bp, Arabidopsis thaliana
aagattgctttcgattttgaaattttcaacgtagtttaatttgaggggttaaaaggattatgtatgtgcatatactttaggttatgttgcttgtagatcaaagggtaaagctagatt

SEQ ID NO: 2859 - DNA, 102 bp, Arabidopsis thaliana
tgttgtttgccatgggactgaggcagcacggcttagcatttctgaagagatcctttctgttcttgatgctgctgcatcagaaaatagtggagtgacaataaa

SEQ ID NO: 2860 - DNA, 70 bp, Arabidopsis thaliana
tcggacactattatgcattcatgaaccagtatacacatatttgtgtgtatgtatgtatatttggtgaaaa

SEQ ID NO: 2861 - DNA, 109 bp, Arabidopsis thaliana
tgaacaaacatcttcgtcatcatcatcattatcttcaaaaacgttttgagttttttttgctttggttttttcttttgatgaatgagaaaaagatttgtgttgtttgttg

SEQ ID NO: 2862 - DNA, 83 bp, Arabidopsis thaliana
aaaactgagaagagatgaagaagcagaggagaatccaatgagatgggcattgagaattcgatcttcccatcttcgctcacacc

SEQ ID NO: 2863 - DNA, 86 bp, Arabidopsis thaliana
gagattttgaatgtaaagtttcaaactttagggtttagcttgatagatatgaatcttgatgttgattttactcaaagtatctgaat

SEQ ID NO: 2864 - DNA, 107 bp, Arabidopsis thaliana
gtcattttcatcattatcatcatcatcttcttcttcatcgtcatcatgtaacaataacaacataaaatgggagatgaggcctggagggatgctggttcagaagagat

SEQ ID NO: 2865 - DNA, 127 bp, Arabidopsis thaliana
ttttagaatagtgaaaggtaaagccgtaagggattcatggttacaaatgagggtgtgttgtgatctttgtaattcgaattaggctatacttgttataattactttacactttgaacttaaattttgg

SEQ ID NO: 2866 - DNA, 185 bp, Arabidopsis thaliana
atcacgtctcttatttttcttcaattcatcaatcatcatcatctattcttacttttcaaggaacggattttgttaactaaatgattcacacccttgaagaaacacgatctcgtgtgaatcatttcgttaacaaaatccgtctttgaagagtaagtatattgtgaaaaagaaaagtggtgacgttt

SEQ ID NO: 2867 - DNA, 117 bp, Arabidopsis thaliana
tgaacctccagtgtgaccgaaacgcaacggaaacgacatttgatcgtataaatccaaagattgttgatgatgttgctgaaactgttgttgttgacgagccatttcagagtaactcaa

SEQ ID NO: 2868 - DNA, 85 bp, Arabidopsis thaliana
agagaacggtgttagggtttccgacaacggtgagaaaaagtctgatgttgttgttgatgttgacgagaaaaatgagaagaatttg

SEQ ID NO: 2869 - DNA, 135 bp, Arabidopsis thaliana
aacttttgtatgattatacttaagctacggatgaagagatcgttaattttgcggcaattatatatttatatttttttgtagcattgttgctggatttgtgtgtatcaaaaatgttgatattagtgaagagagaat

SEQ ID NO: 2870 - DNA, 111 bp, Arabidopsis thaliana
ctaaaagttaccccacacacagatatgaaattatatatacaagattttaaaagttaccatcaaagtggctgtagtttagtggttagaattccacgttgtggccgtggagac

SEQ ID NO: 2871 - DNA, 125 bp, Arabidopsis thaliana
cgtggacttttgttgaatagtgatgtccgtggacttttgttgaatagtgattagtgaatgttcatgttttggatattttaacacttttgtgagacggtcagtgaacttttgttgaatagtggatg

SEQ ID NO: 2872 - DNA, 93 bp, Arabidopsis thaliana
ttaacattagctgatgggtttaactttaggtttcagctttcacaggggacacttgtgagtgtttgttcttggtttgttccttttgccaatgtc

SEQ ID NO: 2873 - DNA, 87 bp, Arabidopsis thaliana
catggcgtgtatgtatgaatgcatgaatgtatgaatgcatggcgtgtatgtatgaatgcatggatgcatgaatgcatggatgcatga

SEQ ID NO: 2874 - DNA, 100 bp, Arabidopsis thaliana
aattaaatgtagtgagatgagtgtttgagaaaaaaggtaatttgatgataaagaaatcatgatgtaaattcttcatagatccagctcatctcattgtaat

SEQ ID NO: 2875 - DNA, 136 bp, Arabidopsis thaliana
acaaatagaaaccataaccatattacataagaacttttattcacctgtgtagcactaggtgctggtgcagatgcggttgatgccccacttggagaagccttggtctatatacaaacgttaaaacttgttagcatcc

SEQ ID NO: 2876 - DNA, 121 bp, Arabidopsis thaliana
aacttcattgatgagactggatcacatttagatgagttgtggcatattgatatctttgggttcttgaaattacatttagactatgtgctcttactatatagactgaattcggtcatcaggt

SEQ ID NO: 2877 - DNA, 143 bp, Arabidopsis thaliana
ataattaattaaattattacttaaatgggttaacccatttaacaactcaaaccatcaaattaaatgagttatgggttgacccaacccattttgttaaactcatttgattatgagttgagttgagttgggttacccattttgac

SEQ ID NO: 2878 - DNA, 133 bp, Arabidopsis thaliana
tatacccacaaaacgtacttgcttctcatataaccatcttgaatcaagagtgtgtcatttctctgattctgtgatcttggtaaattcttcaaaccatacagaaaattctccaagagaaatgctttctcttttc

SEQ ID NO: 2879 - DNA, 84 bp, Arabidopsis thaliana
atcggtattgcagtttgtgcatcattataacatctgtaattatctttagtgatgtttatctcaatagattgtaatacattttga

SEQ ID NO: 2880 - DNA, 93 bp, Arabidopsis thaliana
ttagagatgttaatgctttcaaggagaacggtttctgatgttggtgcagcaagatctgacgtagtaggagatgggcctgagcttggacatacg

SEQ ID NO: 2881 - DNA, 74 bp, Arabidopsis thaliana
aataataggtacgatgatcatcctctcttcttgtctttcgatgagatgaatgtggatggtgaatactggtgtga

SEQ ID NO: 2882 - DNA, 67 bp, Arabidopsis thaliana
aatgagggtgttttgttgttgcagttagtgctctgcagtatgttcaccgcaaactaaaggaccctct

SEQ ID NO: 2883 - DNA, 137 bp, Arabidopsis thaliana
tcgccacttttaaattaacgcatcaaaatgttcaaaacaaaagagaggttgaaataacagaaaaaaaaaaagtaaaaggctcttccatcagctttgtttttgttgaatcgaccttggttgtttgacaatgtgtatct

SEQ ID NO: 2884 - DNA, 99 bp, Arabidopsis thaliana
gtacgtacatattcgcttaagaagttagttaaactatgtttcaggatagaggaaatgttgttgttggtaagactgtctgcttaggttcaatgtttggga

SEQ ID NO: 2885 - DNA, 126 bp, Arabidopsis thaliana
ccaccattccatttctcctagtctttatcattttgtgcatcatgatagcattgaggttcttcttcttcaccaagttcttctgccattactaacgcataagcaaaatgggtatagtctgacagctta

SEQ ID NO: 2886 - DNA, 100 bp, Arabidopsis thaliana
attaacaaattttttagttaacaaattgctttgcatgggaagtgacattaactcggaaggaatgttgtttgtttacgtaaaagagtgaaactaggagatt

SEQ ID NO: 2887 - DNA, 115 bp, Arabidopsis thaliana
aaaaagaaaaaagctttgcgtttgggactatgtcacagcttcttgttcttcttgtggatggtttcaagaactcaactatgagattgttgttgatagagttttagttttgggtttg

SEQ ID NO: 2888 - DNA, 71 bp, Arabidopsis thaliana
tgttgatagagttgttggtgatggttctcatgtggatagagctgttggtgatggttctattggtgatggag

SEQ ID NO: 2889 - DNA, 78 bp, Arabidopsis thaliana
aagctcaacgcgttgttggtgatgatgttgatggatctaatggaagacgatcagccatggttttcttagcagctacac

SEQ ID NO: 2890 - DNA, 135 bp, Arabidopsis thaliana
atagaagaataatctcgtgtgaaaaaagaagaagatacaacaagaatgtgtattgtgtcatggggtagttgtttgtgtcaattcttctgtatccaaatgttcttgttctccttccgatctctcagactcaataag

SEQ ID NO: 2891 - DNA, 76 bp, Arabidopsis thaliana
gcgcctgaagttttcgcaccattcatattagatgaccatcacttgtactatgtgaatgcttttgaaaacgcggcaa

SEQ ID NO: 2892 - DNA, 76 bp, Arabidopsis thaliana
cagggaatacgaatcaaaatggttgctgctggtgcagaacacactgctgcagttacagaagatggtgacctctatg

SEQ ID NO: 2893 - DNA, 123 bp, Arabidopsis thaliana
tgagtgctttggtatggaatctaggatgttgtgtgggctaacggagaattatatggtggttaagatttgattacatttgtttagtgcatggatttggtttgtatgatcaaggtaataaactag

SEQ ID NO: 2894 - DNA, 68 bp, Arabidopsis thaliana
cttctctgggccgaaacaggtgtcgatcgacaccaggagtgtgtcgatcgacactctcgctgaatctt

SEQ ID NO: 2895 - DNA, 135 bp, Arabidopsis thaliana
ttatgtctgaattctgaggcgaaggtgcttgttgttgttgtggagtgaaactaagtggtggctgctgttgttgatatcctccttgaaactgctgcttggaacaaacccttggctttagttgtaagaaactaacag

SEQ ID NO: 2896 - DNA, 105 bp, Arabidopsis thaliana
gtagtcagggaaaatgacgcagaggtctggaggccttctgatgctgttgagtgcatggaagatgcattgggtaccactgtagcatggcctgttgacaaagtggtg

SEQ ID NO: 2897 - DNA, 113 bp, Arabidopsis thaliana
ctttcgtttgatgagttcttagcggggttgaattcgtattgaagagagctttctaacaaggtatagatcaagttctaattcttcctgaaaagaaatccaccattaaagatcat

SEQ ID NO: 2898 - DNA, 75 bp, Arabidopsis thaliana
ttctgagctatcatatatactatatatcattgggtagatgggagtctgttcttgtatgtgtctgttggctctaac

SEQ ID NO: 2899 - DNA, 141 bp, Arabidopsis thaliana
ataagtttttcttcttcttgctctgtcgccactaactaggtcaccgccaagtaacatcggatcgagagagagagagcgatggcgagagatatgaatgtagtggagattttggatgatgaggaggaggatgagaaggagtgt

SEQ ID NO: 2900 - DNA, 101 bp, Arabidopsis thaliana
atatcgatgttgcttagtgttaacgagtttgacttgggattttgattatgaagttttctgtagatgagctcattgtgcactctagatgttcgataaaatgt

SEQ ID NO: 2901 - DNA, 109 bp, Arabidopsis thaliana
gttgagtgcggatggatcagagggtcgaggtggtggtcgagtaggttggttgacagaatggtctgtgctgcttcttggcctctgtgatcgagtaagtgtgtcagctgtc

SEQ ID NO: 2902 - DNA, 94 bp, Arabidopsis thaliana
ctaagaggatggaagttggcgtatgtgtgttgattgtagagcaatcaacaatatcatggtgaagtatcaacaccctatacctagattagatgac

SEQ ID NO: 2903 - DNA, 125 bp, Arabidopsis thaliana
taccatttctcatcatttgtcatcactttacatatttaggataggtttgcatgcatgttgcatatttgtgtttatttcaggtgacttggagctgttgacgagctaactggaagaaggggacctga

SEQ ID NO: 2904 - DNA, 134 bp, Arabidopsis thaliana
ttgtgtaatgtgtaatgttaagtgtgtgctttagttgtgtaagtgataagagtgtaagtttattgtgatgtgtctgcttagtaacaagagttcgagtgtattgtgtaatgttaggtgttaaacttagttgtgta

SEQ ID NO: 2905 - DNA, 89 bp, Arabidopsis thaliana
gtctagggtttttgctgggccggaactggtgtcgatcgacaccaagagtgtgtcagtcgacactcctcgcagattcctgaaccaaaatc

SEQ ID NO: 2906 - DNA, 95 bp, Arabidopsis thaliana
aatcatgaggcgaaggtgcttgatgttgttgtggtggaaaaccatgtggtggctgctgttgttgataacctctttggaattgttgctttggaaca

SEQ ID NO: 2907 - DNA, 78 bp, Arabidopsis thaliana
atgacgctggttgtggttgtgtggaaagtaacaagcaccaatgttgttatgttgcattagctcatctacaacgtcagc

SEQ ID NO: 2908 - DNA, 87 bp, Arabidopsis thaliana
tcttggacttttctggaccgaaacttgtgtcgatcgacatgaagagtgtgtcgatcgacactctctctgattcctgaatctaaaatc

SEQ ID NO: 2909 - DNA, 90 bp, Arabidopsis thaliana
aaataggagagaattgttgttgttcttgatcaaatacaaatccttttgatctcatctggagaatttgttatcaggaattaggctacttta

SEQ ID NO: 2910 - DNA, 77 bp, Arabidopsis thaliana
gagaagccatagacgatttgtgcttgtttgcttttgaatgtatggatgaacaagtatgagtttagtgtttgtgttcc

SEQ ID NO: 2911 - DNA, 133 bp, Arabidopsis thaliana
tagactcaagactaacaacgttttgcttaaccaacatcggtttgcgaagctgagtgattatggtttgtccattgtctctgaagcaaccagacataacacagttaagctcgtttctttaatgttctgtttctgt

SEQ ID NO: 2912 - DNA, 130 bp, Arabidopsis thaliana
ggaccatctgtatccgcaagagaagaagcatttctacgagacgaactggtacggctttggcaatatcacattcacaaaccagagttaaatcattgtacttattaaaagtgtttttcttatataatcaggc

SEQ ID NO: 2913 - DNA, 110 bp, Arabidopsis thaliana
ggttttttctgggccgaaactggtgtcgatcgacaccaagagtgtgtcgatcgacactcctcgctgattcctgaaccaaaatcgtcctaagcttcctttttcataacttt

SEQ ID NO: 2914 - DNA, 86 bp, Arabidopsis thaliana
gtaacaaaaacacaacttgatcatctctcttttctgggtttatgattcgagttactgatgatctcttgttgtgttttctcagtgaa

SEQ ID NO: 2915 - DNA, 98 bp, Arabidopsis thaliana
ttgttgtcgtcgtcatctgtttcttcgtcatcttcctcttcgtcattttgaggagcaagaggcggttattgaataacaggagaccgtggttgacgagc

SEQ ID NO: 2916 - DNA, 121 bp, Arabidopsis thaliana
actatatttagaatcgatgccactgtgtttttatgatgtagttgtttatctatcattatttataggtatgtctctgcatgtgaagctgcatggaggattcttggttatgatattcactttc

SEQ ID NO: 2917 - DNA, 104 bp, Arabidopsis thaliana
cttgaaagcgtcttggacttttgttggcccaaaactggtgtcgatcgacaccaagagtgtgtcgatcgacactcctcttgattcctgagtccaaaatcgtcctt

SEQ ID NO: 2918 - DNA, 133 bp, Arabidopsis thaliana
cttaccttttaaatctcttatctacattctctaattatgattacacaaagatcaaacccattcctttgtgctttcatgatcatgagtgagtagttgtttagagttctttagttaaggtagattaggatgattt

SEQ ID NO: 2919 - DNA, 135 bp, Arabidopsis thaliana
ttatatctgaattttgaggtgcaggtgcttgttgttgatgtggtgtgaaacaaggtggtggctgctgttgttgatatcctccttgaaactgctgctttagaacgaacccttggctttggttgtaaggaacaaacg

SEQ ID NO: 2920 - DNA, 99 bp, Arabidopsis thaliana
cgaagattaacggcgcacatggtaggtgactctcctgatgatgatgtacaacaccatcctaatccggaaaattgatcactttctttccatgatccgtca

SEQ ID NO: 2921 - DNA, 83 bp, Arabidopsis thaliana
ctactgctgctgctattgcctatggtcttgataagaagggtggcgagaagaatatccttgtgtttgatcttggtggtggtact

SEQ ID NO: 2922 - DNA, 95 bp, Arabidopsis thaliana
ttcgagattataagtggtttctactttgtaaatgatcaatctttttcgatccgtggtgatgattttggttttaggcagatcactttcttctctac

SEQ ID NO: 2923 - DNA, 93 bp, Arabidopsis thaliana
tggtgttaattgtgttagtgtattgacattgaattttatggtttatagattgtagtgatttgatgatgatgacatttttcaaaatttagaccg

SEQ ID NO: 2924 - DNA, 98 bp, Arabidopsis thaliana
tagagaagaaaaagtgtggttccaagtggagttttgaaagttgttttgtaagcccataatgcatcatctaactggaaagaccaatcctttttcgactt

SEQ ID NO: 2925 - DNA, 85 bp, Arabidopsis thaliana; identical to SEQ ID NO: 91

SEQ ID NO: 2926 - DNA, 113 bp, Arabidopsis thaliana
tttcaaatttatgatgaaaaatcatgaactttcaaaatgtcatttaaatcataaagttttgttcgacttttggataaaatgattaagttttcttggcttttcgttattagagt

SEQ ID NO: 2927 - DNA, 111 bp, Arabidopsis thaliana; identical to SEQ ID NO: 2572

SEQ ID NO: 2928 - DNA, 71 bp, Arabidopsis thaliana; identical to SEQ ID NO: 2888

SEQ ID NO: 2929 - DNA, 131 bp, Arabidopsis thaliana
ctccctctctctttttctcacactctctttttctcacactctctttgtcttcttagtgttcgtgtgtgaatgaattttaattgcaggtgatagagataatggacgacagagttgggaagaggatgcaagta

SEQ ID NO: 2930 - DNA, 120 bp, Arabidopsis thaliana
gcagtaagtgtcgaattcagcatatgcacatactgctttgtctgctcattgctctttttctgaccgtatctgatctcaagcctgcgagcctggtagtctgtacagttggaacaagacaca

SEQ ID NO: 2931 - DNA, 119 bp, Arabidopsis thaliana
taggtcttactctgtgtttgacaatggttctgtccattgttgttgatgttgatgatcctcaatcagcgaaggagaagacaatggatacgttgtggaataaaccgcacagctctgaccta

SEQ ID NO: 2932 - DNA, 89 bp, Arabidopsis thaliana
tgtattacatgtagccctttccacctggtcctgctgctgctaatgctggtgctttagctagttggatggctgctgcctctggtgcttct

SEQ ID NO: 2933 - DNA, 77 bp, Arabidopsis thaliana
ttctacagccctcaacatcttggtttcatctggtgctgatgcacaggtgtgttatgctgcgtcttgttgttgttgtt

SEQ ID NO: 2934 - DNA, 108 bp, Arabidopsis thaliana
ctctttcttgtgcctcctcgttatctctgatggtttaggtagtttgatcttgatcgttccttgttccattgaaaccctaaacttctacgacgttgacacagacgagtc

SEQ ID NO: 2935 - DNA, 98 bp, Arabidopsis thaliana
gggcggaagatggttcattgttccttttcagaatctcgatcctacgattaacatctttgagttgttgttcaatgacataaccaaaatctcgaagctca

SEQ ID NO: 2936 - DNA, 101 bp, Arabidopsis thaliana
ggaaagcccaagagtattttggttagtgatgttgatgactttctagtagtttcttatgaggattcttcttatcaactctcaactgattcatatagggcaga

SEQ ID NO: 2937 - DNA, 119 bp, Arabidopsis thaliana
gatagagagtgagcacacatagcttcaagcatggaaccttcaaatatgcaagaaagccaccatgtgtgctcactctcttctgtcaccatcaattcctcaccactcaaaccgtcgacaaa

SEQ ID NO: 2938 - DNA, 124 bp, Arabidopsis thaliana
ataaggcggtggaggaggagaatatatcggttggtaattagtggtagtttggaggagttttctgttgctgttagcttcagaaactgtgaataagattgccaagagaaaaactagggtgtagaaa

SEQ ID NO: 2939 - DNA, 145 bp, Arabidopsis thaliana
taccgtttctcattctttattcccattctctagtttatctcttagtcaaatttaatatacatagtccaatctattgaactacttacccacatcagcttattagagctggtgtactagtacttcaatagattggactatatatatt

SEQ ID NO: 2940 - DNA, 86 bp, Arabidopsis thaliana
aaatgaggcgtgagtctccatggctatggaaagtagaaagcagacggcttctatggctattaggactcacatttgctctcattgtt

SEQ ID NO: 2941 - DNA, 73 bp, Arabidopsis thaliana
tgatgagagatttcaagggtagtgctgatgagttttcaattggaggacctggtggtgttgctggtgcctcttg

SEQ ID NO: 2942 - DNA, 128 bp, Arabidopsis thaliana
aagccttgtaatttttaattatgtatgtgttcatgtgtgcatacatacatgccttatttgtttgaatttagaatacaggttttgtatgtgttcatgtgtgcatacatacatgccttatgtgtttgaat

SEQ ID NO: 2943 - DNA, 73 bp, Arabidopsis thaliana
gagaggaatggccctgtgttccgttttttcatggatcttggtgatgcaggtgcattgacacttctctttgtaa

SEQ ID NO: 2944 - DNA, 77 bp, Arabidopsis thaliana
ctttggaatgcgacatgcaatatgcacgtatctttcttttggagtcatttgaatcgtgtgtgtgtgtgtgtagctat

SEQ ID NO: 2945 - DNA, 89 bp, Arabidopsis thaliana
aaaaaagtttgtaggcatgttcgtttcatcagtaagatggatcatttcgatggagatgagttttgatgttcgtttggtgccaaaaacgg

SEQ ID NO: 2946 - DNA, 86 bp, Arabidopsis thaliana
aaccaagacctcacataaaacaattttccactcaatatatcatttgtgtgtgattgatgacgcagtgttttggtagtggtattttt

SEQ ID NO: 2947 - DNA, 110 bp, Arabidopsis thaliana
acttctttaagttcacaggatcgaaattgttcttgtagctaacacaagctttttctcgtcgcaggttgttgttggtgcaggagaagacatccaggtttaaatgaagaaca

SEQ ID NO: 2948 - DNA, 109 bp, Arabidopsis thaliana
ttattggagattggtgtgtgtgtgtgtgtgtggggggggggggggggggtctcatgttgtttcattgttttccaattaattcttgacactgtttatacataaatatatg

SEQ ID NO: 2949 - DNA, 114 bp, Arabidopsis thaliana
catctctctacatagaaagcggtaatggtgatgatgatcgtcgtcaaagccatgataatcatcatcatcatcttcatcgacaacatcagagtggtcatcatcaaaatcaaaatc

SEQ ID NO: 2950 - DNA, 104 bp, Arabidopsis thaliana
tgatttagtgttgtgtattaggtggttaacagtataatcaaagtttttctgttgaaaattagagattttgttgttggtgtttagctgaatatcactgagtgctg

SEQ ID NO: 2951 - DNA, 119 bp, Arabidopsis thaliana
aaactaacaaagtaaatagtttcttatcaacgtttgaattttaacttactttgttgttgtttagttttacaatcgtagtaggcatttaggatttgatttgaattactttgttgttgtta

SEQ ID NO: 2952 - DNA, 100 bp, Arabidopsis thaliana
agaattctgtaacgaactgtgagtaagagagatgtacgtacaaagaagaaagctgatggatcgtcttcttcgtcatctgagttgttgtttgtaagattta

SEQ ID NO: 2953 - DNA, 85 bp, Arabidopsis thaliana
ggaaggctaagagaagtgttttctgagtttggtgaggttgaagatgttgttattaggagtaccaagaagaaatgttctgctctta

SEQ ID NO: 2954 - DNA, 77 bp, Arabidopsis thaliana
attcctcaagcaccttggcgtgcttgttctgttttgagagcttgttcttaaagtagttcagctgctgattgtcctca

SEQ ID NO: 2955 - DNA, 94 bp, Arabidopsis thaliana
gaaatctttagtgttgagatgattcgatgactttttcaggaggaagatgaggagaagcaatctgatgatgttgatgatgctgaggagaaacaag

SEQ ID NO: 2956 - DNA, 136 bp, Arabidopsis thaliana
tggatttagactaattaaccaaaataaccggcccgcagcttcttcttttttggggctctagatgatgatgatggttgttcaagcgatcacgaactcaaattttctcgtcgtaatgaaaacaaaaaaaagaagagga

SEQ ID NO: 2957 - DNA, 120 bp, Arabidopsis thaliana
gaaagagtgaagtcgctggaggcagcggttcatcgatcaattcctgtgaatatttatttttgtttacaaaagcaagaatcgatcgataaacctctgcatccagcgctgcttgctcttcat

SEQ ID NO: 2958 - DNA, 78 bp, Arabidopsis thaliana
actgtgtgtgtgtgtggtacctctttaagccggtcttttacagcatgacgtccgctgcatattttcatagttgttgaa

SEQ ID NO: 2959 - DNA, 72 bp, Arabidopsis thaliana
attttgctaagcgagcttcataataatgcagatatttttgtctgttgatggtgaaacaaatccttagcagta

SEQ ID NO: 2960 - DNA, 99 bp, Arabidopsis thaliana
atccagtggaagatcaatacaaagtgctgtgtgtgatgatgttccgtcgctacggccgcgatggtaaagacatagaacaggagcatttcgttttcactc

SEQ ID NO: 2961 - DNA, 85 bp, Arabidopsis thaliana
aaaatcaacaagaggagaagcagagagaaggaaaacataaagctgaagagttcttcttcctcttctagatcttcctctgataatc

SEQ ID NO: 2962 - DNA, 78 bp, Arabidopsis thaliana
atcatcatgatgatatctatcatgactatggtatgttgatatggtgatgaagacgatagtatgatgatgatggtgatg

SEQ ID NO: 2963 - DNA, 102 bp, Arabidopsis thaliana
aaaatttacgaacaatgtatgtgtgtgtgtttgtctatatatgtagagcacagtagatacatactaaaacataccgtgttgggcatatcacatcacatcatt

SEQ ID NO: 2964 - DNA, 61 bp, Arabidopsis thaliana
cttatgtatgtgaatgatgatgatgtgtgctcatcataagacatatatataggaggagaga

SEQ ID NO: 2965 - DNA, 131 bp, Arabidopsis thaliana
atatccgtagagtggtatgctttcttcttttctcgtttatgtaaccagtgttgtacttgatatctttgatttcttatatctcttactgtttgctaaatagttgaaatctcgtacttttcttttatatgtaa

SEQ ID NO: 2966 - DNA, 130 bp, Arabidopsis thaliana
ctatgggacgcatcacatgggattttcgcaggtctaaagacgaagattggggatctaactgtatttatatccctggtatgcgtaacatcacgcgcctccttattgagcgtaactcttgggatcattttga

SEQ ID NO: 2967 - DNA, 72 bp, Arabidopsis thaliana
tttttgctgtgcatcatgtttcagctgctgtgcatcatgttttagctgctgtgcatcatgtttcagctgatc

SEQ ID NO: 2968 - DNA, 97 bp, Arabidopsis thaliana
ctgtaagtaaactttataaacattaggattcgccattgaatgtgcaaggctagacttgaattgtgatgatgatgattgattgtttacaggtaggaga

SEQ ID NO: 2969 - DNA, 95 bp, Arabidopsis thaliana
tttaagtgattggataatggtattttggatcttgatgattaaaaattgggtatgatcgagcgagtatttgaggtatatagttggatcaaattgtc

SEQ ID NO: 2970 - DNA, 75 bp, Arabidopsis thaliana
tttccgcagttgcagttgcactcgaccgtcgtgtctgaataaaaagaagagctcatgctgcagctgcaactgcaa

SEQ ID NO: 2971 - DNA, 135 bp, Arabidopsis thaliana
atctagattggtcgatgagtagtacagttgattagatttatggagttttaaagattttctgagagagagagagaccaaattgtagttattgtgtttacatgctttcatagtcttgcagttgattgtacgattgat

SEQ ID NO: 2972 - DNA, 92 bp, Arabidopsis thaliana
agacaaagagattcagcctgttgatgggcttgtgtctgaggcaagaccaagattgtataagccagtaaaaaactatgtggacctcttaaaca

SEQ ID NO: 2973 - DNA, 101 bp, Arabidopsis thaliana
atttttttctttttgaagtgttggcttttgatgatgatgcttctcatgttctctcattattttgcttcattatgaagccattcaagtatgttttttttacc

SEQ ID NO: 2974 - DNA, 77 bp, Arabidopsis thaliana
cccatacatgtggttggttttgatgattcacaagttaccttgttttggttttattaggtacttcctgcgtggttgaa

SEQ ID NO: 2975 - DNA, 69 bp, Arabidopsis thaliana; identical to SEQ ID NO: 1050

SEQ ID NO: 2976 - DNA, 80 bp, Arabidopsis thaliana
catgaactctgttttgtgagttgtgagagtagttaggttcaacttttgctatgatttcaggtttacttcttcagggttcc

SEQ ID NO: 2977 - DNA, 96 bp, Arabidopsis thaliana
tcttttcagtaacaagcggcttgaaaacaattacttcatcatcatcatcttcctcacccatataaatctgttgatcaagctgcattattggcgagt

SEQ ID NO: 2978 - DNA, 111 bp, Arabidopsis thaliana
tgttaacttaagccaatatttttcagagttagagaaaagttttagatgttgaaacataggtggtttcttcttatttgtcactaaaccttattgtacttcagttaactaaaa

SEQ ID NO: 2979 - DNA, 81 bp, Arabidopsis thaliana
tcagagagatcgagttttctacaagaagatgatgatcatagtcataatcgatgttcgtcttcaagtggttcgaatctttgt

SEQ ID NO: 2980 - DNA, 80 bp, Arabidopsis thaliana
ctgatacatggtggtggtggccatgactttgagcaatgttgaatgacatcatatccatcatcatcatcatcatttaacat

SEQ ID NO: 2981 - DNA, 135 bp, Arabidopsis thaliana
tcgatttatatcattttcagctggatttttgtttagaatcgtatcagtgtcttgttattcaaatttctgcatctgaaattaagtcacttgttggaattttaaagctagttttccaatggaaatctgaatcataca

SEQ ID NO: 2982 - DNA, 76 bp, Arabidopsis thaliana
gctatagtatatactatgcacacatacagatattgcacgtacgttaagtgtgtgtgtgtgagttaattatgggaaa

SEQ ID NO: 2983 - DNA, 126 bp, Arabidopsis thaliana
ctgtggttgttatatgttgtaggaagaaaatgatctttaatgtttgatatcttcttggatttgattgattgaatgattctgattctgcattttggtactgtttttttttttgtatttgtagggcaa

SEQ ID NO: 2984 - DNA, 94 bp, Arabidopsis thaliana
agaaagatggttacttgaagtggtttgctggaaatgtagcttcgggaagtgctgctggagcaacaacttccttgtttctgtaccatttggatta

SEQ ID NO: 2985 - DNA, 75 bp, Arabidopsis thaliana
ttacagcacaagaactaaaaagctttgtggagagtccctttaaataatgttgaagttgtttgttgtgaacaaaaa

SEQ ID NO: 2986 - DNA, 81 bp, Arabidopsis thaliana
ccgattttgatctcgaactcgattctttctcagatgaaagtatcaaaaattgagaatttgaggttgtttgagtcttaatca

SEQ ID NO: 2987 - DNA, 87 bp, Arabidopsis thaliana
aagtgagaagcgaagagagtgggggagaaaataaaaaaggagtcagagaggacacagtctctttctctctctcaagtctcaacatat

SEQ ID NO: 2988 - DNA, 104 bp, Arabidopsis thaliana
atggtttggtatattgggtgcatgccacgtgtcaatggtaatggtgttggctttgattttggcggttgttattggtgttgggattgtgagtttgtatgtagaaa

SEQ ID NO: 2989 - DNA, 107 bp, Arabidopsis thaliana
gttctgagtggcctatgtttgagtggatgcatgttgattgctttgctaacttgttgcaactggcatgcatgttgccccagaaggaagaccatttgagaaatcggata

SEQ ID NO: 2990 - DNA, 82 bp, Arabidopsis thaliana
gaaactgagctcagcaagatttgtgatggcattttgaaccttcttgaggctcatctcattcctgctgcttctttggctgagt

SEQ ID NO: 2991 - DNA, 121 bp, Arabidopsis thaliana
gttattggttgaagggtttaagttgttgtagtagttgttcaagttgaagtagtcttgttgttgcatgttgttaagacttgagctatcataatttggctgcatggtcaatttctctctctct

SEQ ID NO: 2992 - DNA, 87 bp, Arabidopsis thaliana
ttcgattaaacgttcatcatgatgatgatgatgatcttttgttttcttgttttgaattcgccattttaatgatagaagttttttcga

SEQ ID NO: 2993 - DNA, 105 bp, Arabidopsis thaliana
aattaagtatgtgcaatcaaaacgaggaagcatgatgtgggagaatgaagatccaacggttgtgagaacagatcttcctagtgccgctcttttgtctgcacttgt

SEQ ID NO: 2994 - DNA, 132 bp, Arabidopsis thaliana
tgttggtaaaactgcaatttcagaagggtaagttatcatcaaaagattcagaagttgcacatatgtgtatgtaatgctaagatattgcatctccacttttgaatcagacttgctcagaggattgtgcaagga

SEQ ID NO: 2995 - DNA, 137 bp, Arabidopsis thaliana
aacgtcatcttctcagcgacaatgtaagcttatctaacacaatgatgatcactgatcagtcacatctctctttctctgaagattttggctttgtatatgatcctcttacttttgctgcagcatgatccatttaaccg

SEQ ID NO: 2996 - DNA, 136 bp, Arabidopsis thaliana
taagatttcgagtaattatttaatttaaatccttttatattatattgtaagtgtgtccatttgtatgtgtgttaatgcgttatacaaatggatatactatataagtatatatggcacccaagaggttaattaattt

SEQ ID NO: 2997 - DNA, 81 bp, Arabidopsis thaliana
aaatgttaagttcttcactgatgactggagtagatgaagagctttctgcattgctagttgttgttgtggaggaaacttgac

SEQ ID NO: 2998 - DNA, 79 bp, Arabidopsis thaliana
gaaacttgacttttcctttagttgaagttggattcgtgggaactgattgaactgagactttggtgtttgtttctcttac

SEQ ID NO: 2999 - DNA, 96 bp, Arabidopsis thaliana
tctggttcagtaactttgattcatccacgtctagagacccagctctgttatgatgatgatgatgcggttcattgttctgttttccaatgtttgttc

SEQ ID NO: 3000 - DNA, 93 bp, Arabidopsis thaliana
tatgaagatgctgatcatgatgatgacgacgatgatgatgtttgtgatggtggtggtagcgatggtgatggtgatgtgttagttcatatagaa

SEQ ID NO: 3001 - DNA, 92 bp, Arabidopsis thaliana
ctttcaagattatccttcattgcgagtaacgaaacaaagagagtgatggtaatggcaattcacactctctgtctctctccaatgtcttgctc

SEQ ID NO: 3002 - DNA, 90 bp, Arabidopsis thaliana
tctgggagttcgattagagatccaaaaaaatactcttggagtgggaacttcattggctgattatcttcttcatcatctactccctcaatg

SEQ ID NO: 3003 - DNA, 89 bp, Arabidopsis thaliana
cctcgagtttctgttttgtattgcatctttttttgtattcttagagaaaaagagaaagagaataagagagtgagagagcgagagaattt

SEQ ID NO: 3004 - DNA, 179 bp, Arabidopsis thaliana
attgcacaagagaatatgaaaaagtattaacacaagccttatagcttggcaatctcatgtcaaataaggaaaagaagaggaacccaaggtatgtttctcatctaccttctttgacatgggactgcctaagctaaaggcttgccatgttatcacatccttctttcatttcgtcgcaacca

SEQ ID NO: 3005 - DNA, 88 bp, Arabidopsis thaliana
gatggccatgtgtatctgtgtgtgtgaaggagagagagatctctctgtctttctctctctgttttcttcacttgtggatgctaattca

SEQ ID NO: 3006 - DNA, 144 bp, Arabidopsis thaliana
aaactgtgttataaagaggcaaagttgctgctgcagagttgtgtggcccttgtcaaagtttagcatctctctctttctctgtgtagccttctcttcatatatttcatatctaaactgtactttttatttaattttcctggaaac

SEQ ID NO: 3007 - DNA, 94 bp, Arabidopsis thaliana
ggaactgggcctatagcaaaaaagggagacaaagttgtggtaaggaaatttctgcatatctatggttttgtatccttggtctcaagtttatcta

SEQ ID NO: 3008 - DNA, 80 bp, Arabidopsis thaliana
tggacggacttatgaaactccatgtgcatgtgtgtcaatctcattttatgatatataagccaagattccaagtctcttct

SEQ ID NO: 3009 - DNA, 84 bp, Arabidopsis thaliana
ttcggttcgtgctcgctccattgtaatgacgagagatgcaaaacctagatcttcttcttcttggtgatggtgtgattatggagt

SEQ ID NO: 3010 - DNA, 82 bp, Arabidopsis thaliana
agacacgaaaccaaagagagggtgttgcctagtcagcatctgatgacgtggcatagctctcgtgtgtgtgtgtctctacaaa

SEQ ID NO: 3011 - DNA, 126 bp, Arabidopsis thaliana
acatttgtacagaagatgatgctatgtcgtaaaatttggagagaccatgtgttgtttgtcttcttctatttggttatgatctcgatggtttatattcgacattccttgcacgtcaatgagaggctt

SEQ ID NO: 3012 - DNA, 96 bp, Arabidopsis thaliana
ttgtttctcaggcagaagctgctgctgctgctggtgaaagtagctttaaatccttcatggttgctgtgcaacgttgcggtagcagtgttgctatag

SEQ ID NO: 3013 - DNA, 137 bp, Arabidopsis thaliana
tgcaccccgttgagagcttccactcggtatgggtgagacacgactactattgaattcatacttcttgttcttcttatgtcgactgtccacttgtctcatggattccattaatgaaaatctagctaactgtccatcgg

SEQ ID NO: 3014 - DNA, 123 bp, Arabidopsis thaliana
gaacatgtctgtttgttgaaggtgtctgtctttccaaagaagaatagcttaatggaaagttttgtatttgttgctcttgagttaggctgcttttttgacctgcttggcatgaaattagcagat

SEQ ID NO: 3015 - DNA, 80 bp, Arabidopsis thaliana
tatgatgatgatgatttccaactaaatcaagctcaaacagatctgaactcgaatcacttgcaacatcatcatcatcatcg

SEQ ID NO: 3016 - DNA, 125 bp, Arabidopsis thaliana
gcattgatattcttattcttagagtcatgttgttatttttggtgagatcttagagtcatgttgttgagaagttaattcttatttccattccgattttttggaaatcattcgaaaacaacgttact

SEQ ID NO: 3017 - DNA, 98 bp, Arabidopsis thaliana
aaatgcataattgataacggatggttttgttgtgatctgtagattaaaaatctggcagctgaggtttgtcttgacagggcttatgttcttgaattgct

SEQ ID NO: 3018 - DNA, 73 bp, Arabidopsis thaliana
gctagcataaggtcaagctttataccttccactccttctttttggtcatgatcatcttcttcttgtgctgcta

SEQ ID NO: 3019 - DNA, 239 bp, Arabidopsis thaliana
gttttttctgtttcgtttttctaacatattatttagtgtcataactagataaatatatgttgatgggggaaaagaagttgacagaagagagtgagcacacaaaggggaagttgtataaaagttttgtatatggttgcttttgcgtgctcactctctttttgtcataacttctccttcatgaatcttccttattccattgttctagttatgattttgtgttcttatctgtctctgcatac

SEQ ID NO: 3020 - DNA, 136 bp, Arabidopsis thaliana
gtagtattttggtaaaataacaaaacaaattcggtgcgaaacgcagtcacctagtgtgtgtattagtgtatatataaaatgagtgtgtgtttctaaaatgatatatgtctaattatttgcacatggatgcatattg

SEQ ID NO: 3021 - DNA, 130 bp, Arabidopsis thaliana
tctcagacacttgaagaaagccttgacagtttgaggcatgagcttgcaacaatctcttttgtgatctctctcttgctgcatcttcgctatcttctaagttcctctatatgtgactttctcctcaaatttt

SEQ ID NO: 3022 - DNA, 103 bp, Arabidopsis thaliana
gtggcattctcatacatgttagagaaaacaagaactaaagctctctgggattcggaggttatgtctttggttttctacatgatgaacaagcagcaaacataaa

SEQ ID NO: 3023 - DNA, 71 bp, Arabidopsis thaliana
atttttacaggatagtttgtatgggaatgttgtctgcttggggaaagaaggcgtcattcctatacttacat

SEQ ID NO: 3024 - DNA, 74 bp, Arabidopsis thaliana
gattcctgctgctgctgctactactaccactgctcttcttgtctagtactagagcagcagcacagtggtaaatt

SEQ ID NO: 3025 - DNA, 92 bp, Arabidopsis thaliana
gtttctagcaacgtgtgttgttggtgctggactgcttttcatctgcttgagctgttgaggcacacaaatgacttcataagttttactaacaa

SEQ ID NO: 3026 - DNA, 94 bp, Arabidopsis thaliana
gaggagtgtctctgagatagaccactactactgctgagtgcctgacataaagggtataaaattggtgtatatatagtggttcgtgttttgagat

SEQ ID NO: 3027 - DNA, 156 bp, Arabidopsis thaliana
attttggagtttagttggaagaagagtgagagtcgctggaggcagcggttcatcgatctcttcctgtgaacacattaaaaatgtaaaagcatgaatagatcgataaacctctgcatccagcgtttgcctcttgtatctttcttattgacttgaatc

SEQ ID NO: 3028 - DNA, 74 bp, Arabidopsis thaliana
aacattaatcatgatgatgatgatgatgatgacgaagatgatggggataatcatgattatgatgatggtaatga

SEQ ID NO: 3029 - DNA, 125 bp, Arabidopsis thaliana
ttatataaataattgaaaaccgccaaaagtgattgtgtaacgtaacatgtgttgcagagttgcaggtggtggtgttccacctagtatatatgaaatattgaaaaatctgattgtcttggccaaaa

SEQ ID NO: 3030 - DNA, 75 bp, Arabidopsis thaliana
catcatcaatgatgtcatcatatctatatgtatgttcctgcacaatttgatatgctggtcatcatcaatgatgtc

SEQ ID NO: 3031 - DNA, 90 bp, Arabidopsis thaliana
aatgcggagccaaattgagcaactgcaaacagaactcttgttctataggggtgatagtggtgcttttgatgagctccaggtattcaatct

SEQ ID NO: 3032 - DNA, 91 bp, Arabidopsis thaliana
agaaacaaattctatgcaagtttttgaagatgatgaatgcttacttttctaagagattcaataaatggttcatctcgaaaatttgtgttca

SEQ ID NO: 3033 - DNA, 117 bp, Arabidopsis thaliana
gaggaacgtaaagtctgagactttggctgcgtaatctgttgccaagtagactgaagaagagttgaggttggtgtgagagatgggtttagggtttagattgtgcatatgttccataca

SEQ ID NO: 3034 - DNA, 89 bp, Arabidopsis thaliana
tgaaagaatagagtactgatggcagaagaaagattgaaatctgtttggcatgcttttgctgtgactctctctctctctcacacacctaa

SEQ ID NO: 3035 - DNA, 137 bp, Arabidopsis thaliana
gtacgtgccaccacctaagattgctaaaagttaattctcaggttttttctgctttcactgatgttgtatatatgtatgaaacaaacacagggaatagcgagaaggctggtgagaagagcgataaccatagctgcgaa

SEQ ID NO: 3036 - DNA, 116 bp, Arabidopsis thaliana
ttctgcatggctttagatgttgcttttggtggtcacagatcgttgtcatcctcttcgtctccgtcggtagaggatgagaagaagaaaccggcgcccagagcaaaaaaatctgacga

SEQ ID NO: 3037 - DNA, 116 bp, Arabidopsis thaliana
tttttactgagaaaaatgatttttctctaatgtgcagtttttatctttctttgcttggtgtatttgccatatgtcatttgttgttgggttggaatggggtttgatgatttgtctcg

SEQ ID NO: 3038 - DNA, 100 bp, Arabidopsis thaliana
tacatgcatgaacatgtgtttgagaattttgtgatcatgatacggggtgcttcatgcatcatcatgatgatgatcatcatacatgttagtttggaagtcc

SEQ ID NO: 3039 - DNA, 101 bp, Arabidopsis thaliana
attcatattaccaccttaattgagaaagtcatataactttattgacatgcacttcttgtttatacatgtgtgtgttgatgtcgtttcgtatcatttcctcc

SEQ ID NO: 3040 - DNA, 114 bp, Arabidopsis thaliana
agtttgatgaatgagtacctgaattgtatggttttggagtagtggatgacttaacgaaggttgtttatatatatccacacaatcgtatatgacattctcactcaactatgaaaa

SEQ ID NO: 3041 - DNA, 118 bp, Arabidopsis thaliana
ggctgagcttttgggggttaaagtttaagagaagtgtatagagaaaaggagttttccttctgtgtgaattttgatgtttataacttgataacccctttggtgtttttctggctaattt

SEQ ID NO: 3042 - DNA, 99 bp, Arabidopsis thaliana
aaggtttcgggttctggggaagaggtagctgagaagaagaagccgaagcagcaaccttcttcatgttcttcttcaaagctttcttcgccttggcaccca

SEQ ID NO: 3043 - DNA, 88 bp, Arabidopsis thaliana
ttgtttttcttttgatatgtctttctctacttcttcgatcacattactcatacaagtgtcagcgagagagagagagacacacacaatt

SEQ ID NO: 3044 - DNA, 125 bp, Arabidopsis thaliana
gtcgttgtttgtaggcgcagcaccattaagattcacatggaaattgataaataccctaaattagggttttgatatgtatatgagaatcttgatgatgctgcatcaacaatcgacggctacaaata

SEQ ID NO: 3045 - DNA, 129 bp, Arabidopsis thaliana
tctttggggtttgctagttcttagaatttcactgattaagaaagattgatccttttgccttgatcgatcggtaacagattcttatagtgtcattgaagaagtttagtcttttgaatttcataataggtg

SEQ ID NO: 3046 - DNA, 88 bp, Arabidopsis thaliana
acaactttctgggattggcattggtagaaatgaagcttgggtagtgcttggtgacttcaatgaattgatgaccaataccgagaaaatg

SEQ ID NO: 3047 - DNA, 109 bp, Arabidopsis thaliana
catagattaccattgttaatgtcaaagttcatgaacttgtatgtcaaaatcaattgttggattgtttcatgtgtttaaattttgtcataacttgttatcgaaagtggta

SEQ ID NO: 3048 - DNA, 95 bp, Arabidopsis thaliana
ttaagtaccaaaagacatcaaagttctagagtagatattatagagagtagtcatcatgctgcttcttcttctcaagcagctgcactgtgtttggc

SEQ ID NO: 3049 - DNA, 128 bp, Arabidopsis thaliana
acttcattctacatcatttggagatttagtttagtctgtgcgtggtttctgaattagatttgtttgttcttatggtatatagataaagctacacttccgaatttctatgttgctgctggaattggggg

SEQ ID NO: 3050 - DNA, 450 bp, Arabidopsis thaliana
caataacaaggtttgcagttgaagtaacctttttcaatcatcatatccatttacaacgaccttaagtataagtagatatatggggatgtaacgcatgttgttttctgcgggaagcatttgcacatgtttcgtggagaatgaaatcacattccatacatgaataataattaccttttagatagaacatcgtactgcttgaaaaaacatgttaatgtcataaactttatgatgaaaacacctataaaaagcgttttttcaagcatgtgctatctatgaaggtaattactattcatgtataaaatatgattttatcctccataaaacatgtgcaaatgctttctacaggaaacaatatacgttgcatccccatctacttacacttaaggtcgttgtcaatgaatgtgatataatgttactttgactgtaaagcttgagagcagtggtttcatc

SEQ ID NO: 3051 - DNA, 138 bp, Arabidopsis thaliana
caatcttcatcgctccattcacacacaatcctcatcatcatcatcatcaccatattgataattatgatattggataatgatgatgatgatgatgatgatcatttacacaacacccacacacgaacattcacaatcata

SEQ ID NO: 3052 - DNA, 75 bp, Arabidopsis thaliana
cagttatcctgttcatactcctcataacgttcataatcactctgcgtgggggtgagagagagacagagagactca

SEQ ID NO: 3053 - DNA, 82 bp, Arabidopsis thaliana
gtatcagcgctggaagtaacgttgttagtctcaggcataggaatgatttgtagctgagaatgctgctgatgttgttgcgatt

SEQ ID NO: 3054 - DNA, 98 bp, Arabidopsis thaliana
tagcgtttgcttgtaacgatagtgagtgagagagaaagacaatagtctttaggttttgtcttttgggttgttgttgtaactacttgtaatacagtttt

SEQ ID NO: 3055 - DNA, 73 bp, Arabidopsis thaliana
cgaaactgtggttgaagaagaagaagactcattatcattgtcttcgtcatcttcttcaattttgcttcgtttt

SEQ ID NO: 3056 - DNA, 79 bp, Arabidopsis thaliana
gatgactgtctctatctctgtctgcacggaggagagtgagagatctgcgacttcacgacaggaagatgatagagagagg

SEQ ID NO: 3057 - DNA, 90 bp, Arabidopsis thaliana
ggcatcatcagactgctgttgttggtggtggctcgtctatcgagactggaactaagctttacatttcaaacttagactatggtgtctcca

SEQ ID NO: 3058 - DNA, 87 bp, Arabidopsis thaliana
tttatacagtctggttcactggagtttctgtgattatgttgagtacatactcattcatcctttggtaactctcaagtttaggttgtt

SEQ ID NO: 3059 - DNA, 81 bp, Arabidopsis thaliana
aaaactccagtgagaaggaaattgattgttgatgatgattctgaaattgggtcagtgttaattattcttcttactcacaaa

SEQ ID NO: 3060 - DNA, 85 bp, Arabidopsis thaliana
cctatcacggagctgaagaagtctgcatgtgggatctcatgactaatactgactccattgtatgatgcagattctccataacata

SEQ ID NO: 3061 - DNA, 121 bp, Arabidopsis thaliana
cgggaacgtcttcggatctgttacgagataaaggagttgagggaacggagctctctgtttggctttcttcatcttcctcatcgaacgtgtgatacaaatcttccctttcttgatcgaatgt

SEQ ID NO: 3062 - DNA, 135 bp, Arabidopsis thaliana
agctatctacttttgcagaggtatattgtagagaagaagaggaatgagaaatggagctttttacatatatatgaagaagacttatgatttatcaatctggttaagctttccgagtccattgcagttagcacaaac

SEQ ID NO: 3063 - DNA, 99 bp, Arabidopsis thaliana
agaatctggaaaacgtatatttcagtttggtttcgttgtatgttagattaaatcaattcttgcaaaaagaaaccatctagtaaccctcaccagttcgac

SEQ ID NO: 3064 - DNA, 78 bp, Arabidopsis thaliana
taggagtaggaggaggaacaagaattgacaagggtaggcttggaatttcaccatcttcttcttcttcatgctcttccg

SEQ ID NO: 3065 - DNA, 96 bp, Arabidopsis thaliana
aatggcatacgattagtgagaagctcccaaagcacgattccaaagctgtagacatcaactttgttgttgtaatgcttcttctctccttgacgcagg

SEQ ID NO: 3066 - DNA, 77 bp, Arabidopsis thaliana
ggtctacattggctgttcttggacttgtccctgattctcaaggaacacaaacaagccaagtgcaagcgaatgagaca

SEQ ID NO: 3067 - DNA, 141 bp, Arabidopsis thaliana
caataacaatataagtaattaggtagataaattctcatatgtatgatgaaataaatcaataagacaaaaaaaaaaaaaaggttgattctcttcttgtcactgttgtgagagctttgtttttttaggtgaaatattaggggt

SEQ ID NO: 3068 - DNA, 73 bp, Arabidopsis thaliana
actgcaaatgaaatgtcgaacctgtgactgatttggagttattggttctcttgtgatatgcagatacaataat

SEQ ID NO: 3069 - DNA, 124 bp, Arabidopsis thaliana
tttagagaagtacaagcaaatctgtttgaagagtttacttcttttggaattacaagtagttttgatctggtttttatcgtcacattgctgcgagtgaaagtagtagagttcttcatgtttgtat

SEQ ID NO: 3070 - DNA, 74 bp, Arabidopsis thaliana
taaccattttaagagattagagactgtgatgtatgtttctctgtctctgagtttgttctgttctcttttggctt

SEQ ID NO: 3071 - DNA, 88 bp, Arabidopsis thaliana
ccattttcttcgtttaggttcatcagatttgtgttgttgttctccgcagggcgatttcgcttctgattattcttaacagctttttatc

SEQ ID NO: 3072 - DNA, 129 bp, Arabidopsis thaliana
cctatttgaccaggcccattagatacacgattcacaattttacttccaaatcaagaatgatgttgatgttttactttgtggaatcatgaaatcgtagtgtaaaagaagaaatactgaagtaggtgaatt

SEQ ID NO: 3073 - DNA, 66 bp, Arabidopsis thaliana
caagtctgagtgtgtatggtgtgagagagagaccacattcatgtaatcattacctacattcagata

SEQ ID NO: 3074 - DNA, 107 bp, Arabidopsis thaliana
acatatatgcatttagccttctgtatacgcatttgcatgcatgcattaatgagtttcttctgatatacatgtgtgaggatttgtatatttaattcaaaaatatttgc

SEQ ID NO: 3075 - DNA, 125 bp, Arabidopsis thaliana
gtgcaatgtgaagattttgttgttgtgtatacttgtgtgtgtgtatttataagggttttgtttttgggttggagtttggtgtgtagtacaatgtacatttttacaacaataatgcgataattgtg

SEQ ID NO: 3076 - DNA, 88 bp, Arabidopsis thaliana
tattctcgttatcttcaatcctcggcaatgcatatctgtctgaatcacgaccaatgaagctatgtgttgttgaagaacaagaagaatt

SEQ ID NO: 3077 - DNA, 107 bp, Arabidopsis thaliana
ctctcatttttcacatatgtatcagacatttaatcaagcacatatctacgtgttgattatgttgatgatgctgagattatgttgatttagagaatgagtattggtga

SEQ ID NO: 3078 - DNA, 102 bp, Arabidopsis thaliana
atctgaccagattaggtttgcagacgagggcaattttgggttgagatcgttgcctgaaacactcaccgtgaaagactgcttctcgttcactgacttcatgga

SEQ ID NO: 3079 - DNA, 92 bp, Arabidopsis thaliana
gtagtccggttgagacggaagtgaacccatgtagacaacatacaccttcatggattgttatcatcgttatcatcgtgaactatggatcaaat

SEQ ID NO: 3080 - DNA, 95 bp, Arabidopsis thaliana
gcagtgctgtctttagagcccaattatgttgtgtttggtgggaaaatgagagatgatttggtggaggctctgaccgcgcaatgtattgaagtaga

SEQ ID NO: 3081 - DNA, 73 bp, Arabidopsis thaliana
acttgagatagatgaaaatggaagttttgtgctttcagatttcagggagttttggatttcttcatctttgtta

SEQ ID NO: 3082 - DNA, 119 bp, Arabidopsis thaliana
agggaatgaagtaggaatcacatataagcaagaagaagctatggaactcaggatggatagcgccaacagatatacatgtacgcatatacaaaacatacagcactggtgagccatggcgc

SEQ ID NO: 3083 - DNA, 92 bp, Arabidopsis thaliana
atagaatctttgattgcttgtgatatgggggacgaagataattgatctgaatgttgatttttcttcttctttttcccagatgggagagacga

SEQ ID NO: 3084 - DNA, 76 bp, Arabidopsis thaliana
ccatgcgtagcaagtatcttcattattaactagtggacacttggcagattgtcagcttatgttggagatgctgctg

SEQ ID NO: 3085 - DNA, 75 bp, Arabidopsis thaliana
aaagatccagctttgtgctatgtgtttctgatgaataatgggagatacattgttcagaaagtcaaagatggagac

SEQ ID NO: 3086 - DNA, 70 bp, Arabidopsis thaliana
ggaagaagccacgtgttgtttggtctcaggagcttcaccagaagtttgtcagtgccgttcagcaattggg

SEQ ID NO: 3087 - DNA, 135 bp, Arabidopsis thaliana
ggcagctcggtatcttcttgatcgtcatttccattcttcttctcatgtctcatctcttgatcttcttggctactttttgggaacgattcaagggttagtcacattatggagtcttttctaattaggtaaaataat

SEQ ID NO: 3088 - DNA, 112 bp, Arabidopsis thaliana
atttctagttgataagcactttgataagcactctgttcaacattcttcaagtcagttcttaatgcttcaagttagtagttgtgtgcttgtgagtaagaaagctagaggtaaa

SEQ ID NO: 3089 - DNA, 127 bp, Arabidopsis thaliana
cgtgtaaccttagtagatgaatttctctcttggctctgtttctgtttaacacataacttttgatttctctgttctgttgaactgttagtttgattcatctactcttgacctttgaatcctctttcct

SEQ ID NO: 3090 - DNA, 147 bp, Arabidopsis thaliana
tgaggatcatgatgaagaagagattgagcttgaggataacatttgtaagactagagaagattgaaatgtgtttttgttgttttcttttaaagttttataatgtagaacataatggtcaaaggttatgatatttcttcttcttttggt

SEQ ID NO: 3091 - DNA, 114 bp, Arabidopsis thaliana
aaactccgccgccgtggcatcgtcaggatccgcaacggaggaagaagaagaagaagaagaagaagcttgattctgtttctgattcgattgttgctgatgctgctgcttcgagga

SEQ ID NO: 3092 - DNA, 133 bp, Arabidopsis thaliana
tcttaagtattggggtcctacaactacgactaatttcccggtaattttgtctctcatttttgtatgtctgtctgaatatgtcaggattgtattttagttgattcattatctggctaaatacttgtattagata

SEQ ID NO: 3093 - DNA, 110 bp, Arabidopsis thaliana
aatccactcactctttgagactctgtaactatgtctgttattagctgattgtccggtcccatccgtggcccttttattatctgtatatatagaagtggagccaaagtgaa

SEQ ID NO: 3094 - DNA, 111 bp, Arabidopsis thaliana
tgtgtgtgtcattttgctctaatctcattttcaatttggtgaagcatacatgatacttgtttcattgttgaattgtatgatgagttgttgaaatgaatgatacgaagctta

SEQ ID NO: 3095 - DNA, 105 bp, Arabidopsis thaliana
aaccaaaaacgcttagagacctctccctcacgtttcttggtcatgatcatcatcgttacaaatgttggatatttgaccaattacgtaccattgagtctaagccaa

SEQ ID NO: 3096 - DNA, 128 bp, Arabidopsis thaliana
atgcttctattgagcggcttcaacagtggagagtaagacctagatccttcttaagtctgatgttgtttcatattgtgagataagaatgcttgtttatctgtgtttgagctaacagtgaattgtgttta

SEQ ID NO: 3097 - DNA, 123 bp, Arabidopsis thaliana
gccaagaaacagaggaagtggttcaagaacaaaaaggtcatgaagatgaagatgaagaagacgagtgagtcatttggaaactcgctcaagtcttgtctcaggctcttgttctcttgcttccat

SEQ ID NO: 3098 - DNA, 90 bp, Arabidopsis thaliana
actttaagctccacgaaaatggtgtgagcattgctttgctgtagaaaacaagaaaaacttgctcatactttgtaaagtggggccaaaaag

SEQ ID NO: 3099 - DNA, 122 bp, Arabidopsis thaliana
gtgtgggcttaggattaggaggtgtaggtgctggtttgggcttaggtttaggaggtgtaggtgctggtgcgggcttaggtttaggaggtgtaggtgctggtgcaggcttaggtttaggaggt

SEQ ID NO: 3100 - DNA, 88 bp, Arabidopsis thaliana
ggtttgggcttaggtttaggaggtgtaggtgctggtgtgggcttaggtttaggaggtgtaggtgctggtgcaggcttaggtttaggag

SEQ ID NO: 3101 - DNA, 88 bp, Arabidopsis thaliana
ggactgatctagctatgaaaatatgacatagtatgctaccatgtaggacattgtgtttcatattcttggatcaaatgaaacttagaca

SEQ ID NO: 3102 - DNA, 64 bp, Arabidopsis thaliana
taagaattccaatcagctagcagagacgttcctcctgtttgcagcggttgctgctgctgatctc

SEQ ID NO: 3103 - DNA, 94 bp, Arabidopsis thaliana
tctcttaaaataaaggctttattgaatgtagattgatgtggaagacaacaccgtttactgtcttcttcttgttggctctcatgccatggcttga

SEQ ID NO: 3104 - DNA, 103 bp, Arabidopsis thaliana
acgtgaagcaatcttcagaagaaggtgatgatgatgcggtagaaactgtagagcaagctgaagtgtctagtgatgatgatgatgaagctgaggccattgaaga

SEQ ID NO: 3105 - DNA, 136 bp, Arabidopsis thaliana
tcacttagcttctctccctcctccatcgcctctcatggttagtgactcctactcttggtgtgttgatgatgttgattgtcaaggtttctctgcggccaaaacttgggaggttctaaggcctaggcgtcctgtcaag

SEQ ID NO: 3106 - DNA, 107 bp, Arabidopsis thaliana
cttctccagtttgttattgacaggtttctgtttcggagctttgtaatgttgttgcggtgatgattcactggccatcttcatctcagcttctgcgagaatccttgtcg

SEQ ID NO: 3107 - DNA, 80 bp, Arabidopsis thaliana
aaattaccagaaaaggagttgcttgatttttgatgtttcctcttggagttatcttgaattgagcttttagatcttgtact

SEQ ID NO: 3108 - DNA, 81 bp, Arabidopsis thaliana
gataatggtgactgacaagtaattggttgagctttgtgttttaaacatgttcataggttttccaatgcgtgtcagccacct

SEQ ID NO: 3109 - DNA, 106 bp, Arabidopsis thaliana
agagaggatttttcaaagacaactcagtttatttcattgatggtgatgatccaagtgtaggaggatcagggcctcagaatctgagcgtttttgaatgggagagtaa

SEQ ID NO: 3110 - DNA, 130 bp, Arabidopsis thaliana
ggaaccacacttagtctgagacatgaatctatgatcttcaaagacataggagcttgtggttgttgctgctttgaagaactgcttctctcttcttctcttgtgttgttattgttgttatctctcatctctg

SEQ ID NO: 3111 - DNA, 126 bp, Arabidopsis thaliana
cagtaggataagaagcggaaacagcagcggatggattgggactgtgagcggtgcagcatctgcagcagctggaatggttgcaggctcggttccgggtacagtcacatccactttctgttactgcga

SEQ ID NO: 3112 - DNA, 83 bp, Arabidopsis thaliana
aaagtttttgtctctgtctctgtcacagtttcttgacaatgatactatgacacagatcaatacagagtccaagtaccactaca

SEQ ID NO: 3113 - DNA, 76 bp, Arabidopsis thaliana
acacaatgccgtctcctccaatgaacctcgggtcataacaagctgatccaggtctgttgcagtttggtttcctcac

SEQ ID NO: 3114 - DNA, 92 bp, Arabidopsis thaliana
actgtctccttctcctccaggacctccatggccacaacggaacttttgagtttttgatcatgtttgtgtgtggaggagcttgatgaagacat

SEQ ID NO: 3115 - DNA, 82 bp, Arabidopsis thaliana
aagggaaaatagatgtgattaacaaacccgaggctgagatttgttaagcttcttttctctgtcttcatcatcttcgtcctcg

SEQ ID NO: 3116 - DNA, 98 bp, Arabidopsis thaliana
ataagttttgttagataagagtattgtagtgtatgtgttgtggaatgtattatgcttttgtagtgtatgtgttggatattggaagtatctgaacattt

SEQ ID NO: 3117 - DNA, 125 bp, Arabidopsis thaliana
tttgaaattgcttgtcaggtcggtcgaatgcaataaacatagccgataggttggggcttccatgtgatatcatcgaaagtgctcgtgaactctatggctctgcaagtgctgagatcaatgaggtc

SEQ ID NO: 3118 - DNA, 73 bp, Arabidopsis thaliana
agaaatgtgggtggatgtgatgtgacgagaagacaaagctcttcaatggcgtcatgttctagttccagatatt

SEQ ID NO: 3119 - DNA, 89 bp, Arabidopsis thaliana
ggagaagaaacaggggttttggattctgatgttggtccactctgggtttttaagagcgggtctgcaaaatctgagttgaggccccaaga

SEQ ID NO: 3120 - DNA, 76 bp, Arabidopsis thaliana
gttatttgagagagagagagagaggctctggaaatcttgtgatccataaattgtctctcttcttttcctctgttct

SEQ ID NO: 3121 - DNA, 93 bp, Arabidopsis thaliana
ttccatatcatttctcgtgtgttggtcgacggaccaacggtgcaaacaatctttgtcttcctcctcactgtcggcttcgaccacatccctacc

SEQ ID NO: 3122 - DNA, 87 bp, Arabidopsis thaliana
cgatcgaagaacatcaaattagaatgtgatgcaaaacttagactcctaacatttgcaacacaatctaatttggtgtttcttcgatct

SEQ ID NO: 3123 - DNA, 109 bp, Arabidopsis thaliana
atacactatgtttccgagagagtccctctgatattggcctggttcactcagattctcttttactaactcatctgattgagccgtgtcaatatctcagtcctctctcgtc

SEQ ID NO: 3124 - DNA, 86 bp, Arabidopsis thaliana
aaaaaaagaaatagttgattgtttgtgttcttgagtacgtgtttatgggtccactagccatcgatactatacattcactatttttg

SEQ ID NO: 3125 - DNA, 98 bp, Arabidopsis thaliana
aaactccatttgatttgctgcctctgctgtgagaggttggtataagtctaccaaagaggcatgtgcatctcgaagaggagaaaagtcaagaggaatga

SEQ ID NO: 3126 - DNA, 89 bp, Arabidopsis thaliana
caagttagttgatattttatgatgatgatcagtgtaacctttgattacgatatattcagtgatctttgtttttatagtatgaggtagct

SEQ ID NO: 3127 - DNA, 115 bp, Arabidopsis thaliana
atacaggggctaaagaaggaaatggtgacaatggtgaaaaagattgaagtgcttgaagtccataaccggtttgtatatatatcattgtcatatttcttttcaaatattttatgat

SEQ ID NO: 3128 - DNA, 104 bp, Arabidopsis thaliana
aaaaccacgaaaagggatttatcaaaggttgaaaatttagtgtgtgtgagagttagagagaaacttgaaatagattgtacctgttgatgaggaggtcttgtggc

SEQ ID NO: 3129 - DNA, 105 bp, Arabidopsis thaliana
caaagaatcgggtaaaaaagggttatgcagggatggtaaggtgagaagaatgaagcgtgtatcatcatcatcatcatcaatgtcaaacctcactcaagtcgaaga

SEQ ID NO: 3130 - DNA, 127 bp, Arabidopsis thaliana
tcattgtctttgaagaactcaagaaagttctctcttcgacaaaacgtgcataagcattgtcgtcgtcgtggtctttgagttttttacttttgtttttattttggctctttgataacttgaatttgaa

SEQ ID NO: 3131 - DNA, 93 bp, Arabidopsis thaliana
atcaaatgagtttataattaaatgagttatgggttagacccaactcattttgttaaatgagttgggtctaacccataactcatttcatttgat

SEQ ID NO: 3132 - DNA, 102 bp, Arabidopsis thaliana
cattgggagtagtagaagaagaagtaggtagatagatagaatcagaaagatctatttgtgtctcttctcttctccctcatttttcaatgttctttatcatca

SEQ ID NO: 3133 - DNA, 102 bp, Arabidopsis thaliana; identical to SEQ ID NO: 3132

SEQ ID NO: 3134 - DNA, 86 bp, Arabidopsis thaliana
aaggggaaacgatatctttggtttttgaatttcaagattgatatttatcgaactttgtgcaaaaaccatctatctctttccaccat

SEQ ID NO: 3135 - DNA, 130 bp, Arabidopsis thaliana
atatccattataaaaaaaaatcaattgtgttggctatattgaataaacaacaggtagatgaatgttgatggtgtgaagtgtgaacacagatatctgtcgtttagcagaaaaaaattgatttgagagatta

SEQ ID NO: 3136 - DNA, 125 bp, Arabidopsis thaliana
aacagttgtatcatttaccatcttgaattagtagaagctgcgtatgaacattttcattgttgtgtgcatttggcttgttgatatgagtagtgatttgtatttgtatattggaggagtgtgatcga

SEQ ID NO: 3137 - DNA, 137 bp, Arabidopsis thaliana
attgatctaaggcagtgccgtgccaagcttccgagaaagatgatgcaaaagatagtgaaatgtgatgatgatgatgacattgtagtgattcttctcttaattttctttttttgttgtttcatttggtaaggtacgac

SEQ ID NO: 3138 - DNA, 87 bp, Arabidopsis thaliana
aaaaaagtcaaatgatgtagttttggtttttggtgcatcagttataagttcatgaggaactggaactgcatttctattgatggtact

SEQ ID NO: 3139 - DNA, 83 bp, Arabidopsis thaliana
tgtgtatttccttcttgttttgttacctcaatttagttctgcattggcagatacttgaactacgagaagaagtggaaatgcaa

SEQ ID NO: 3140 - DNA, 89 bp, Arabidopsis thaliana
tgcattccggtggatctgatggatcgatattggtgtgggaacgtgacgatggtggagacattgtagttgttggaatgcttagaggtcac

SEQ ID NO: 3141 - DNA, 87 bp, Arabidopsis thaliana
aagaggcggagggagtgagtggtgaagaaggtgagaggaatcgtcggtaacgtcgtcttcttcagcatcaaatccttcgaatggaga

SEQ ID NO: 3142 - DNA, 90 bp, Arabidopsis thaliana
ataatcatctccgccgccacctccgccgccgccgctgcaggagtcccaaatacggcgggagaaggaagaggaagggattagggtgttgga

SEQ ID NO: 3143 - DNA, 90 bp, Arabidopsis thaliana
acatccctgttacatttacaatcacatcatggcattagattggtaaagaatgaaggtttgagattggtagtgatgataaatgtaaaaaac

SEQ ID NO: 3144 - DNA, 74 bp, Arabidopsis thaliana
acatgataatacagggttttgttttgaagatggacatgttctatcttctcaagaaaataatccttgaagatata

SEQ ID NO: 3145 - DNA, 73 bp, Arabidopsis thaliana
tttttgttagctaagaagaagaagaagatgcttactgcttcttcttcttcttcgaccacggctaatattgtct

SEQ ID NO: 3146 - DNA, 88 bp, Arabidopsis thaliana
tgttagagagatggtgagatgtggtgggatctttggtgggtttatgataatgacgtcatcgtcttcttcttcatcttcatcatcatgg

SEQ ID NO: 3147 - DNA, 103 bp, Arabidopsis thaliana
atgggtatcatcatcatcagctgaacatcatcatcatcataatcataacatgggtcatggtggtggaggaaggaacagaagctggggatggtcatttgcaagt

SEQ ID NO: 3148 - DNA, 100 bp, Arabidopsis thaliana
ccacgaggttttcgactggcaaaagcgtaacaattgtctcaacaatggtttgttcatgttcagatctctttgttagctctctctcagcgtaactaaccaa

SEQ ID NO: 3149 - DNA, 61 bp, Arabidopsis thaliana
agttgttatgtgttttgatttgtgaagtatgattccacacaagacgaagcgtggagctgct

SEQ ID NO: 3150 - DNA, 90 bp, Arabidopsis thaliana
aacaatatgagactgatcctgcatcagcaagtactatgatatacgcctaaagtaattgataatgaaagcatcggttttcagtttcaaatg

SEQ ID NO: 3151 - DNA, 98 bp, Arabidopsis thaliana
ttggtgaagaagcaatggaggaggttgagagattagatccatgaaagaagaaggatacaaaagggtattttcgtcttcttcttcattgttgaaacaga

SEQ ID NO: 3152 - DNA, 85 bp, Arabidopsis thaliana
tgaactcgggtagattgagaaaattgaagagggggagtggcagattatcatcttcaccttcaccttcatcttcatcttcatcggg

SEQ ID NO: 3153 - DNA, 83 bp, Arabidopsis thaliana
taaagctcagattgttgatgttgttgtcggttgtttcttgctttgtcggaacaagaagctcttcgaacacattcatttgagtc

SEQ ID NO: 3154 - DNA, 128 bp, Arabidopsis thaliana
ataaaccatataatacttaccttcatcttctagttttgcttgagaaatcgctttgaatgttttggcttagatttcttgtttggtagaatacaaagtctgaagaaatttgttttcttttgtttcttttc

SEQ ID NO: 3155 - DNA, 80 bp, Arabidopsis thaliana
ggatatgagcaacgacggtgaggagcatgaagaaaagaacaagattgcgaagcttcaccatcatcgtcgtcgtcagatca

SEQ ID NO: 3156 - DNA, 86 bp, Arabidopsis thaliana
ggtgctggtggtggaggtggtgcgcctgttgcagctgctgctcctgctgctggcggtggtgctgccgctgctgctcctgctgccga

SEQ ID NO: 3157 - DNA, 101 bp, Arabidopsis thaliana
gttgcggctgcggttgcagttgtgattgcagttgtgtggtttcttctagtctggaagaagaagaagcagcagcggcagttgcggttggttccccggtggta

SEQ ID NO: 3158 - DNA, 116 bp, Arabidopsis thaliana
atataatagtttgtcgttatgcctggctccctgtatgccacgagtggataccgattttggttttaaaatcggctgccggtggcgtacaaggagtcaagcatgaccagaagcatatg

SEQ ID NO: 3159 - DNA, 77 bp, Arabidopsis thaliana; identical to SEQ ID NO: 2248

SEQ ID NO: 3160 - DNA, 92 bp, Arabidopsis thaliana
gaaagatccttagtctgagtgtgtgtgattctgtaacaggaacctttcagattcaacgtgcgcatttgcaaactaagaagcaagaagaatct

SEQ ID NO: 3161 - DNA, 106 bp, Arabidopsis thaliana
atccatttgttgttgttgctgctgatgaaacgtttgagattgttgttgattgccaaaaggaagacgagggtgttgaatcggttgagatgtggaagtgggaaccatt

SEQ ID NO: 3162 - DNA, 101 bp, Arabidopsis thaliana
atatgggaccctgaaggaaagagatacattgattttcttgcagcttactctgcagttaatcaggtaatacaattccaaatccgcttcccgtcactctaaga

SEQ ID NO: 3163 - DNA, 66 bp, Arabidopsis thaliana
gttctggatcttcttcttcttcgttgtctattagtggagatgatgatggtggagagatcgaacaag

SEQ ID NO: 3164 - DNA, 104 bp, Arabidopsis thaliana
cgtacatgatcagagttcttttggttatatggtcttgaggttggtctctgctaataagttcaaagcagctgaagatctgattgttagaatgaagattgagaatt

SEQ ID NO: 3165 - DNA, 106 bp, Arabidopsis thaliana
aagagatctttgatgtgccattagagatgttcctcaaggttcttgaactggaaaatcctctgtttccgttaaactccattgctaaaccttaatctttaatggctct

SEQ ID NO: 3166 - DNA, 118 bp, Arabidopsis thaliana
ctcaagtctcttcatttgtgtgtatatttgtctctctctcactctctttcgagttttactgcactgtctgagggagagagaaaaagagagagatgatggagaggttgagacatgaaaa

SEQ ID NO: 3167 - DNA, 106 bp, Arabidopsis thaliana
ttcatatcctcttcttgctcttcgtcgttgttgttgttgttgtcttcaaactccattcaagaagtcgagaaatgtgaaactacgtcgtttttggggagaggaggtt

SEQ ID NO: 3168 - DNA, 92 bp, Arabidopsis thaliana
tatttcttaatcattgtgatttactggttttcttgatgttggagatactcaattaatcagatgatcagatcttctttaataattaagattct

SEQ ID NO: 3169 - DNA, 89 bp, Arabidopsis thaliana
cttgttaggcgaaatgacgcatctaaattggatctttagattgtttttgatgtacttggatctaattcttagttagcagcctttaagta

SEQ ID NO: 3170 - DNA, 99 bp, Arabidopsis thaliana
atgcctaaagagatccaattagcgagaaggattagaggtgagagagctcgaggagagtgatgattttgttgttctgcgaactgggatttcatgggtttt

SEQ ID NO: 3171 - DNA, 147 bp, Arabidopsis thaliana
gatgcgatgattgttaaagttaccggcggtctcggattcgcttggtgcaggtcgggaactgattggctgacaccgacacgtgtcttgtcatggttggtttgtgagctcccgtcttgtatcaactgaatcggagtccgaggtgaaaaa

SEQ ID NO: 3172 - DNA, 91 bp, Arabidopsis thaliana
ttttgcgtatcgtttgttgggtactcgctgggattgttgttgctgttgtagaattggataatagtggggagtgctggagcaatgtgatatc

SEQ ID NO: 3173 - DNA, 138 bp, Arabidopsis thaliana
ttcctcataagatttttctctatttatctgtgcatgtagccttattatattataacgtggattaaaaaaaaaaaaaacatccttcattgtgcgagtgtgtgggtgggtgtatttggagacttttgtgtggaggttttg

SEQ ID NO: 3174 - DNA, 82 bp, Arabidopsis thaliana; identical to SEQ ID NO: 46

SEQ ID NO: 3175 - DNA, 77 bp, Arabidopsis thaliana
ttcgttcttcagtttcgtttccttggttcgatctcggttcggttcattgacgaagaagaagaagcagctttttccac

SEQ ID NO: 3176 - DNA, 125 bp, Arabidopsis thaliana
acttccactgccactattgtttgaagaatttgaacccaagctacgcttcattgttgttgttggggaggaatctcaacgagacggagaagaagaagcattcaacgaaattttccaatttgtaaagt

SEQ ID NO: 3177 - DNA, 122 bp, Arabidopsis thaliana
cttgtgtgagagattcatttgtcaaggtatttggttttattttatcttcttcgatattaggtgtatgtgtgttacttactttgatgttatggtgggtcattgattaggcaggatatgagtat

SEQ ID NO: 3178 - DNA, 156 bp, Arabidopsis thaliana
acttttgttgcaagaaagtgaatgtagatatgagatggtcatggaagaactcaaagctgccattttttttttcttcttttcagtgatctctttgtgttctctgtgtccaaagtcttatcctttcttcagattacagtctttagctcaaaaagcaag

SEQ ID NO: 3179 - DNA, 95 bp, Arabidopsis thaliana
aagaatccatattcggtctatatgaaagtatcaatatggcaattattaatttgatggtggtgatgatggtgacagaggcggtgaaggtggcggtg

SEQ ID NO: 3180 - DNA, 143 bp, Arabidopsis thaliana
agagtacatctatcaaacaattaaaacatagaaattaattatttacataacatacatggatctgtatatgtgtgtatcctcagctattctatgttcagtattcatgtatgtatgtgtgtgtttgttgaaactgatgaaacact

SEQ ID NO: 3181 - DNA, 83 bp, Arabidopsis thaliana
caaagagatggacaataggaggttgtttaagtgtgacaatgtacacagcagaatcatcatcatcgtcttgttgttgtcccaaa

SEQ ID NO: 3182 - DNA, 80 bp, Arabidopsis thaliana
gtgtatgtgtgtgtgagagttgattcataatctgcagtagagtgtaatgattatggttaataacttatatattatattag

SEQ ID NO: 3183 - DNA, 91 bp, Arabidopsis thaliana
tgtcgcagatgggtaaaaacggacggctcagatggaatcctttcagccacagatcgtcttcttcaacctcttcatcttcacgacaacagca

SEQ ID NO: 3184 - DNA, 96 bp, Arabidopsis thaliana
acattgattctcttatggctttactgttgttgatgtaatggtcacagtcgagattaagcatgaatggagcattagtgagtactgcagagactcgaa

SEQ ID NO: 3185 - DNA, 84 bp, Arabidopsis thaliana
tggttaggagacacggtggagatatgtgttggtctctttcgacgttcatagttgttcactctctcttctccaatatttgatttt

SEQ ID NO: 3186 - DNA, 85 bp, Arabidopsis thaliana
gttatacggtggacattaaacacaaatatataaatgcagaggtatgtgtgtgcatatgtctcaagtgtaagtaaattctattcaa

SEQ ID NO: 3187 - DNA, 132 bp, Arabidopsis thaliana
ttcttcttcaaagaaagaacctctttgtttttgtgtgttttgtgttcttgtggttgtctagagagagagaaagacttgttgatgagataagaggctttgtgaagaagattgttttataggaattgaaaagtc

SEQ ID NO: 3188 - DNA, 122 bp, Arabidopsis thaliana
gaagcaaaacgtgtaagttgaggggaatgaagcctggtccgacatcatcatcatcatcgttataatcatgagatcatgagattgaatggtctcgagccaggcatcattcacctgaacttttg

SEQ ID NO: 3189 - DNA, 82 bp, Arabidopsis thaliana
ttaagaagaatgtcttcgtgattttatatgtatatatgcgattgtgtgtgcgtgtgtaagcgaagggcattatttcttgacc

SEQ ID NO: 3190 - DNA, 130 bp, Arabidopsis thaliana
accgcggaacctgtttgatggttagtttcttcatatatctattggtatcaaagagcatttttgatggaaatgtttactgattttgaaatgttgtgatttggcagagcaagaacagtccgtttagcgtgaa

SEQ ID NO: 3191 - DNA, 106 bp, Arabidopsis thaliana
gcagaaagcacattgcgtaagaagaggaagacaaaaacattgagaattcatcaaaagcattttatgttgttgttgttcagatttaaaaattgctgattctgctgct

SEQ ID NO: 3192 - DNA, 94 bp, Arabidopsis thaliana
cgagctaagcttctaaatgctcatctcaattatatatgccttggacggtttttgagaccaatgagtgtatatatggatgacaagatatagtttc

SEQ ID NO: 3193 - DNA, 87 bp, Arabidopsis thaliana
tgagttaccagtggtgaactgcgaagatgctccttgggcactgcataaggttctctgtgctttggattcctggttacatatacaatc

SEQ ID NO: 3194 - DNA, 65 bp, Arabidopsis thaliana
catctctctggtttcatatgcattttcagtcaactgaggtatgtgatgttgttgatgatgatgat

SEQ ID NO: 3195 - DNA, 69 bp, Arabidopsis thaliana
atgatgcatgtgcggatggtgcaagtgttttacaccacgtgatatttgacatcctggtggacatgctga

SEQ ID NO: 3196 - DNA, 95 bp, Arabidopsis thaliana
tgaagatggagcgaaggaggttgctctttgtgttctcggcggaatcaactgtaaccaaaaaacaaccttaaatactttgatctaatttgtctttg

SEQ ID NO: 3197 - DNA, 101 bp, Arabidopsis thaliana
agcagagaagcctgcaagtggcgcacaagctgtggaccaacacccaagatatggaccacataaaagaaagtgcttctcttgtggctaagctgcttggattt

SEQ ID NO: 3198 - DNA, 21 bp, Arabidopsis thaliana
gatttgtacgtacactgttca

SEQ ID NO: 3199 - DNA, 21 bp, Arabidopsis thaliana
tgccaaaggagatttgccctg

SEQ ID NO: 3200 - DNA, 19 bp, Arabidopsis thaliana
ttgattttgatgctgatgt

SEQ ID NO: 3201 - DNA, 18 bp, Arabidopsis thaliana
tgatcctaattcttcttc

SEQ ID NO: 3202 - DNA, 22 bp, Arabidopsis thaliana
tctttctctcatgttcctgtct

SEQ ID NO: 3203 - DNA, 20 bp, Arabidopsis thaliana
tcctttatatgaatgtggtt

SEQ ID NO: 3204 - DNA, 18 bp, Arabidopsis thaliana
cagcaccagcggctgcac

SEQ ID NO: 3205 - DNA, 18 bp, Arabidopsis thaliana
tgtcagttcatgatcaga

SEQ ID NO: 3206 - DNA, 23 bp, Arabidopsis thaliana
tgatgaagaagatgatgatgatg

SEQ ID NO: 3207 - DNA, 19 bp, Arabidopsis thaliana
gagctgctgctgctgctgt

SEQ ID NO: 3208 - DNA, 23 bp, Arabidopsis thaliana
gagctgttgctgctgctgttggg

SEQ ID NO: 3209 - DNA, 21 bp, Arabidopsis thaliana
gctgctgctgctgctgctgag

SEQ ID NO: 3210 - DNA, 19 bp, Arabidopsis thaliana
atctctctgtctttgttga

SEQ ID NO: 3211 - DNA, 19 bp, Arabidopsis thaliana
aacgtagatgatgatgatg

SEQ ID NO: 3212 - DNA, 21 bp, Arabidopsis thaliana
gaagctctctggttttcaggt

SEQ ID NO: 3213 - DNA, 22 bp, Arabidopsis thaliana
ctgagagagagagagagtcaga

SEQ ID NO: 3214 - DNA, 21 bp, Arabidopsis thaliana
tgatgtgtgtgtttgataatg

SEQ ID NO: 3215 - DNA, 19 bp, Arabidopsis thaliana
aatgtcatgatttgcttca

SEQ ID NO: 3216 - DNA, 21 bp, Arabidopsis thaliana
aggggctgagagggtgagaaa

SEQ ID NO: 3217 - DNA, 19 bp, Arabidopsis thaliana
tgagaagttacgttctgct

SEQ ID NO: 3218 - DNA, 19 bp, Arabidopsis thaliana
tatacagtgactttttcag

SEQ ID NO: 3219 - DNA, 23 bp, Arabidopsis thaliana
agcttcagataggctttgtcaga

SEQ ID NO: 3220 - DNA, 20 bp, Arabidopsis thaliana
tgctggtgttcctggagctg

SEQ ID NO: 3221 - DNA, 20 bp, Arabidopsis thaliana
ttgtagaatattggtgttgt

SEQ ID NO: 3222 - DNA, 21 bp, Arabidopsis thaliana
atcgtcttcttcttcttcacc

SEQ ID NO: 3223 - DNA, 19 bp, Arabidopsis thaliana
ttgatagagaagctgtttg

SEQ ID NO: 3224 - DNA, 21 bp, Arabidopsis thaliana
tatgagagtattataagtcac

SEQ ID NO: 3225 - DNA, 20 bp, Arabidopsis thaliana
tagtgataagtatgtgatga

SEQ ID NO: 3226 - DNA, 21 bp, Arabidopsis thaliana
tgagagcgtgataaagacggt

SEQ ID NO: 3227 - DNA, 18 bp, Arabidopsis thaliana
tcatagttgtttgtgcag

SEQ ID NO: 3228 - DNA, 21 bp, Arabidopsis thaliana
attgtagttgtttgtgctggt

SEQ ID NO: 3229 - DNA, 22 bp, Arabidopsis thaliana
taatcctaccaataacttcagc

SEQ ID NO: 3230 - DNA, 20 bp, Arabidopsis thaliana
aagagtagacagagattctg

SEQ ID NO: 3231 - DNA, 21 bp, Arabidopsis thaliana
tgtatcttgatgatggtgatg

SEQ ID NO: 3232 - DNA, 21 bp, Arabidopsis thaliana
atcttgtagaagaagaagaag

SEQ ID NO: 3233 - DNA, 20 bp, Arabidopsis thaliana
aagtgtttggttttagtact

SEQ ID NO: 3234 - DNA, 20 bp, Arabidopsis thaliana
tctcttgttgtggttgttgt

SEQ ID NO: 3235 - DNA, 23 bp, Arabidopsis thaliana
catgaacatcatcatccactttc

SEQ ID NO: 3236 - DNA, 22 bp, Arabidopsis thaliana
tagatcgagattcttcatcttc

SEQ ID NO: 3237 - DNA, 19 bp, Arabidopsis thaliana
cctaacaacgagatttgga

SEQ ID NO: 3238 - DNA, 19 bp, Arabidopsis thaliana
gctagaatctgtgctggga

SEQ ID NO: 3239 - DNA, 19 bp, Arabidopsis thaliana
tcagaaggagatagagaga

SEQ ID NO: 3240 - DNA, 20 bp, Arabidopsis thaliana
aaacttcttcttcttcaaca

SEQ ID NO: 3241 - DNA, 23 bp, Arabidopsis thaliana
tgtgtgtgcttctggatctgtgt

SEQ ID NO: 3242 - DNA, 20 bp, Arabidopsis thaliana
agaggttgatgtttctggga

SEQ ID NO: 3243 - DNA, 21 bp, Arabidopsis thaliana
tttgcttccagcttttgtctc

SEQ ID NO: 3244 - DNA, 23 bp, Arabidopsis thaliana
tacaatgatgatgatgatgatgc

SEQ ID NO: 3245 - DNA, 18 bp, Arabidopsis thaliana
ggagccggcgccggcgcc

SEQ ID NO: 3246 - DNA, 18 bp, Arabidopsis thaliana
ttctcatcttcatgctca

SEQ ID NO: 3247 - DNA, 18 bp, Arabidopsis thaliana
agagtggttttggtgtgt

SEQ ID NO: 3248 - DNA, 20 bp, Arabidopsis thaliana
aatcatcatcttcttgctct

SEQ ID NO: 3249 - DNA, 19 bp, Arabidopsis thaliana
gagtctgatgatgaaggtg

SEQ ID NO: 3250 - DNA, 20 bp, Arabidopsis thaliana
aaagtagcagttgcttttgc

SEQ ID NO: 3251 - DNA, 20 bp, Arabidopsis thaliana
agagagcatgcattgttgac

SEQ ID NO: 3252 - DNA, 18 bp, Arabidopsis thaliana
tgaatgatgatggtgata

SEQ ID NO: 3253 - DNA, 18 bp, Arabidopsis thaliana
aaggtctaatggctccct

SEQ ID NO: 3254 - DNA, 18 bp, Arabidopsis thaliana
aaactggtgtcgatcaac

SEQ ID NO: 3255 - DNA, 20 bp, Arabidopsis thaliana
agaacaacaacagttgctct

SEQ ID NO: 3256 - DNA, 20 bp, Arabidopsis thaliana
tgaatgatgatggtgatact

SEQ ID NO: 3257 - DNA, 20 bp, Arabidopsis thaliana
gaggttggtgttgttggtct

SEQ ID NO: 3258 - DNA, 18 bp, Arabidopsis thaliana
tgaaccctggtggtggat

SEQ ID NO: 3259 - DNA, 18 bp, Arabidopsis thaliana
taagactgctcttgatct

SEQ ID NO: 3260 - DNA, 20 bp, Arabidopsis thaliana
ctggtagtggattctgctgt

SEQ ID NO: 3261 - DNA, 19 bp, Arabidopsis thaliana
tggtagtggattctgctgt

SEQ ID NO: 3262 - DNA, 20 bp, Arabidopsis thaliana
tggctgtgttgttaccagac

SEQ ID NO: 3263 - DNA, 20 bp, Arabidopsis thaliana
tggtagagtgatgatcaggt

SEQ ID NO: 3264 - DNA, 18 bp, Arabidopsis thaliana
ttgctcatctacaacgtc

SEQ ID NO: 3265 - DNA, 19 bp, Arabidopsis thaliana
gccatcgtatttgtatgtg

SEQ ID NO: 3266 - DNA, 23 bp, Arabidopsis thaliana
ttgatgagtgaatgtgtctgtgt

SEQ ID NO: 3267 - DNA, 21 bp, Arabidopsis thaliana
tctctctcctttcttcgttga

SEQ ID NO: 3268 - DNA, 22 bp, Arabidopsis thaliana
tgaatctgtgtggttttgagaa

SEQ ID NO: 3269 - DNA, 18 bp, Arabidopsis thaliana
ttggttttgaagttgttg

SEQ ID NO: 3270 - DNA, 21 bp, Arabidopsis thaliana
tgattgttgttgatgtagcta

SEQ ID NO: 3271 - DNA, 19 bp, Arabidopsis thaliana
atgagagttgtggctgtga

SEQ ID NO: 3272 - DNA, 20 bp, Arabidopsis thaliana
ttggttttgaagttgttgta

SEQ ID NO: 3273 - DNA, 19 bp, Arabidopsis thaliana
ttgttgttgatgttgctga

SEQ ID NO: 3274 - DNA, 18 bp, Arabidopsis thaliana
tgctcgtcatcaacaagg

SEQ ID NO: 3275 - DNA, 18 bp, Arabidopsis thaliana
gcagctgttggttttgca

SEQ ID NO: 3276 - DNA, 19 bp, Arabidopsis thaliana
acctgatgctgctggagtg

SEQ ID NO: 3277 - DNA, 18 bp, Arabidopsis thaliana
ttgttgttgatgtagctg

SEQ ID NO: 3278 - DNA, 19 bp, Arabidopsis thaliana
tatcttctacttcttctac

SEQ ID NO: 3279 - DNA, 22 bp, Arabidopsis thaliana
cattgatattgatgttggatgt

SEQ ID NO: 3280 - DNA, 21 bp, Arabidopsis thaliana
tctttcattgttgcatgtgct

SEQ ID NO: 3281 - DNA, 19 bp, Arabidopsis thaliana
tgtgtttagatctagttgt

SEQ ID NO: 3282 - DNA, 18 bp, Arabidopsis thaliana
gatgatgatggtggtggt

SEQ ID NO: 3283 - DNA, 18 bp, Arabidopsis thaliana
tgacacatgatatgtagg

SEQ ID NO: 3284 - DNA, 21 bp, Arabidopsis thaliana
tcactggtttcagaaagtgga

SEQ ID NO: 3285 - DNA, 20 bp, Arabidopsis thaliana
ttgaagtggtttaattggaa

SEQ ID NO: 3286 - DNA, 19 bp, Arabidopsis thaliana
aaactctagttcttcgtct

SEQ ID NO: 3287 - DNA, 18 bp, Arabidopsis thaliana
agtgttgttggtggtgat

SEQ ID NO: 3288 - DNA, 23 bp, Arabidopsis thaliana
gattctgctgtcactggttgttg

SEQ ID NO: 3289 - DNA, 19 bp, Arabidopsis thaliana
tgaggatgaagaatccaac

SEQ ID NO: 3290 - DNA, 20 bp, Arabidopsis thaliana
agtctttggtgtgcttgatg

SEQ ID NO: 3291 - DNA, 23 bp, Arabidopsis thaliana
catcatcttcatcatcctcatca

SEQ ID NO: 3292 - DNA, 21 bp, Arabidopsis thaliana
tatgtgagtttgagtttgtgt

SEQ ID NO: 3293 - DNA, 21 bp, Arabidopsis thaliana
ggttcgtacgtacgctgttca

SEQ ID NO: 3294 - DNA, 20 bp, Arabidopsis thaliana
tagaatgatgttgttgcttg

SEQ ID NO: 3295 - DNA, 21 bp, Arabidopsis thaliana
tctgatgcttgttgtgtggtg

SEQ ID NO: 3296 - DNA, 21 bp, Arabidopsis thaliana
agagcgagtgagagagagaga

SEQ ID NO: 3297 - DNA, 21 bp, Arabidopsis thaliana
actttgagtggaactatggtc

SEQ ID NO: 3298 - DNA, 21 bp, Arabidopsis thaliana
agctgctcctggtgctgctgg

SEQ ID NO: 3299 - DNA, 19 bp, Arabidopsis thaliana
atctgtgtcttcttcttta

SEQ ID NO: 3300 - DNA, 18 bp, Arabidopsis thaliana
tcgttgatggttttgtct

SEQ ID NO: 3301 - DNA, 20 bp, Arabidopsis thaliana
agagcttgaaaattttagag

SEQ ID NO: 3302 - DNA, 18 bp, Arabidopsis thaliana
gacagaggtttcgatttg

SEQ ID NO: 3303 - DNA, 20 bp, Arabidopsis thaliana
ttttctcttcttcttctctt

SEQ ID NO: 3304 - DNA, 23 bp, Arabidopsis thaliana
tttttgtgtcactgtgtctgtgt

SEQ ID NO: 3305 - DNA, 20 bp, Arabidopsis thaliana
aagtgtctggatcaacatgt

SEQ ID NO: 3306 - DNA, 21 bp, Arabidopsis thaliana
tgtttgctattgctctgtgtt

SEQ ID NO: 3307 - DNA, 19 bp, Arabidopsis thaliana
tgactggtgttaatgatga

SEQ ID NO: 3308 - DNA, 22 bp, Arabidopsis thaliana
atgtatgatgatgatgatgtga

SEQ ID NO: 3309 - DNA, 18 bp, Arabidopsis thaliana
cagtggctgcactctgtg

SEQ ID NO: 3310 - DNA, 21 bp, Arabidopsis thaliana
tgaaagtgactacatcggggt

SEQ ID NO: 3311 - DNA, 23 bp, Arabidopsis thaliana
agtccagcagcagctgctgctcc

SEQ ID NO: 3312 - DNA, 20 bp, Arabidopsis thaliana
ttcttgctgtggctgtcatc

SEQ ID NO: 3313 - DNA, 22 bp, Arabidopsis thaliana
gagcgtgtcaatgtgtgtttct

SEQ ID NO: 3314 - DNA, 23 bp, Arabidopsis thaliana
ttgctgctgctgaagctggtaca

SEQ ID NO: 3315 - DNA, 23 bp, Arabidopsis thaliana
ctgctgctgctgttgttgttgct

SEQ ID NO: 3316 - DNA, 20 bp, Arabidopsis thaliana
gctgctgcggctgaagctgc

SEQ ID NO: 3317 - DNA, 20 bp, Arabidopsis thaliana
agctgcggcggcggctgccg

SEQ ID NO: 3318 - DNA, 20 bp, Arabidopsis thaliana
ttactagtctcttcatggga

SEQ ID NO: 3319 - DNA, 21 bp, Arabidopsis thaliana
ttcatctcaatttgttttgtt

SEQ ID NO: 3320 - DNA, 22 bp, Arabidopsis thaliana
aaatcttcttcttcttcgacgt

SEQ ID NO: 3321 - DNA, 21 bp, Arabidopsis thaliana
tgattgttgatgctgctgaag

SEQ ID NO: 3322 - DNA, 20 bp, Arabidopsis thaliana
atgtggtgcatatttgtagt

SEQ ID NO: 3323 - DNA, 23 bp, Arabidopsis thaliana
tgactttgctcatgttgctgatg

SEQ ID NO: 3324 - DNA, 19 bp, Arabidopsis thaliana
tgagcttggtttcaagtct

SEQ ID NO: 3325 - DNA, 20 bp, Arabidopsis thaliana
agattggtgatggtggtgca

SEQ ID NO: 3326 - DNA, 21 bp, Arabidopsis thaliana
tctctctttgactttgtctct

SEQ ID NO: 3327 - DNA, 19 bp, Arabidopsis thaliana
acagaggcttagatgcagt

SEQ ID NO: 3328 - DNA, 18 bp, Arabidopsis thaliana
caaagaccaaacagtgca

SEQ ID NO: 3329 - DNA, 20 bp, Arabidopsis thaliana
ttgaattgcagtgcttgaat

SEQ ID NO: 3330 - DNA, 22 bp, Arabidopsis thaliana
tctctctctctctttgcttcag

SEQ ID NO: 3331 - DNA, 21 bp, Arabidopsis thaliana
tgatgaatgatgaatatgtgt

SEQ ID NO: 3332 - DNA, 18 bp, Arabidopsis thaliana
caagatggagaagaagat

SEQ ID NO: 3333 - DNA, 21 bp, Arabidopsis thaliana
aactgcattgcctgtgagttg

SEQ ID NO: 3334 - DNA, 18 bp, Arabidopsis thaliana
tcttgttctatatctgag

SEQ ID NO: 3335 - DNA, 21 bp, Arabidopsis thaliana
ttgtgcatgcttttccatagt

SEQ ID NO: 3336 - DNA, 23 bp, Arabidopsis thaliana
tagcttttgttgttcttctagtt

SEQ ID NO: 3337 - DNA, 23 bp, Arabidopsis thaliana
tgatgatgatgatgatgatggtg

SEQ ID NO: 3338 - DNA, 20 bp, Arabidopsis thaliana
tctggttcatgtttggtggt

SEQ ID NO: 3339 - DNA, 18 bp, Arabidopsis thaliana
ttctggttcatgttaggt

SEQ ID NO: 3340 - DNA, 23 bp, Arabidopsis thaliana
tctgctgttgttgttgatcctcc

SEQ ID NO: 3341 - DNA, 20 bp, Arabidopsis thaliana
tgttttcaacctacagtgtg

SEQ ID NO: 3342 - DNA, 18 bp, Arabidopsis thaliana
tcaaattggttgtttttg

SEQ ID NO: 3343 - DNA, 18 bp, Arabidopsis thaliana
gttgtgatgatgttgtta

SEQ ID NO: 3344 - DNA, 20 bp, Arabidopsis thaliana
tcatcgttatcttcttcctc

SEQ ID NO: 3345 - DNA, 19 bp, Arabidopsis thaliana
tgtcctcttcatcttcaac

SEQ ID NO: 3346 - DNA, 18 bp, Arabidopsis thaliana
ttgtgcattgcatttgca

SEQ ID NO: 3347 - DNA, 19 bp, Arabidopsis thaliana
agactgtgtattttgttct

SEQ ID NO: 3348 - DNA, 23 bp, Arabidopsis thaliana
cgctgtggtgtggtttgtgcatg

SEQ ID NO: 3349 - DNA, 19 bp, Arabidopsis thaliana
attggtttatcggttttga

SEQ ID NO: 3350 - DNA, 18 bp, Arabidopsis thaliana
tcactgtcttgctctctc

SEQ ID NO: 3351 - DNA, 23 bp, Arabidopsis thaliana
tcttggaggtggtcttgctgctg

SEQ ID NO: 3352 - DNA, 20 bp, Arabidopsis thaliana
ccccaaatgtagacaaagca

SEQ ID NO: 3353 - DNA, 19 bp, Arabidopsis thaliana
tcagtgcttttctttttca

SEQ ID NO: 3354 - DNA, 18 bp, Arabidopsis thaliana
tgtgctctttttcttgta

SEQ ID NO: 3355 - DNA, 20 bp, Arabidopsis thaliana
gtgcttgcatcttgcttttg

SEQ ID NO: 3356 - DNA, 22 bp, Arabidopsis thaliana
tttgttagtggttggcgtcagt

SEQ ID NO: 3357 - DNA, 18 bp, Arabidopsis thaliana
tgtcgatgaagattgtgt

SEQ ID NO: 3358 - DNA, 18 bp, Arabidopsis thaliana
ttgtgagtgttcatgact

SEQ ID NO: 3359 - DNA, 18 bp, Arabidopsis thaliana
tatgacatcaagttctct

SEQ ID NO: 3360 - DNA, 21 bp, Arabidopsis thaliana
tcactcctcttcttcttgatg

SEQ ID NO: 3361 - DNA, 18 bp, Arabidopsis thaliana
agtgtggctctgttactg

SEQ ID NO: 3362 - DNA, 21 bp, Arabidopsis thaliana
tgatatgtctgtaaatgttgc

SEQ ID NO: 3363 - DNA, 18 bp, Arabidopsis thaliana
tctttggttttgtttctc

SEQ ID NO: 3364 - DNA, 19 bp, Arabidopsis thaliana
tgtctctgcttatcgactg

SEQ ID NO: 3365 - DNA, 23 bp, Arabidopsis thaliana
gctggaccaggcggtgctggtgg

SEQ ID NO: 3366 - DNA, 21 bp, Arabidopsis thaliana
tctctctgttgtgaagtcaaa

SEQ ID NO: 3367 - DNA, 21 bp, Arabidopsis thaliana
ttggttacccatatggccatc

SEQ ID NO: 3368 - DNA, 22 bp, Arabidopsis thaliana
atattgttcatcttcttggtga

SEQ ID NO: 3369 - DNA, 19 bp, Arabidopsis thaliana
gacaattggagagagtggt

SEQ ID NO: 3370 - DNA, 18 bp, Arabidopsis thaliana
actatctctgtctcttca

SEQ ID NO: 3371 - DNA, 20 bp, Arabidopsis thaliana
gtgagctagaggttgagtgt

SEQ ID NO: 3372 - DNA, 19 bp, Arabidopsis thaliana
tggttcttgttcgagctgt

SEQ ID NO: 3373 - DNA, 20 bp, Arabidopsis thaliana
aacttcgctcttgatgggtt

SEQ ID NO: 3374 - DNA, 22 bp, Arabidopsis thaliana
agctcttggaggtggaggcggt

SEQ ID NO: 3375 - DNA, 23 bp, Arabidopsis thaliana
catgcatggttgtgattttcaag

SEQ ID NO: 3376 - DNA, 21 bp, Arabidopsis thaliana
tcatggtcagatccgtcatcc

SEQ ID NO: 3377 - DNA, 21 bp, Arabidopsis thaliana
tttctgtgtgtatatgtctct

SEQ ID NO: 3378 - DNA, 20 bp, Arabidopsis thaliana
gttgtgtctgttttacttac

SEQ ID NO: 3379 - DNA, 21 bp, Arabidopsis thaliana
tctaagtcttctattgatgtt

SEQ ID NO: 3380 - DNA, 23 bp, Arabidopsis thaliana
aggtattttcatgatgttgttgc

SEQ ID NO: 3381 - DNA, 19 bp, Arabidopsis thaliana
tctgaatatgtatgagtgt

SEQ ID NO: 3382 - DNA, 20 bp, Arabidopsis thaliana
ttgttcttgacttagggtca

SEQ ID NO: 3383 - DNA, 20 bp, Arabidopsis thaliana
agtgatatgacattgtgtag

SEQ ID NO: 3384 - DNA, 23 bp, Arabidopsis thaliana
taagtaactgtgtgtgtgtatct

SEQ ID NO: 3385 - DNA, 18 bp, Arabidopsis thaliana
agagagagagagagactg

SEQ ID NO: 3386 - DNA, 23 bp, Arabidopsis thaliana
tgctggtgctgtggttgttcagg

SEQ ID NO: 3387 - DNA, 21 bp, Arabidopsis thaliana
ttaggattgttgttgttgaat

SEQ ID NO: 3388 - DNA, 22 bp, Arabidopsis thaliana
ttacttgaccatttgttttcat

SEQ ID NO: 3389 - DNA, 19 bp, Arabidopsis thaliana
agatgaacaagtttgatct

SEQ ID NO: 3390 - DNA, 20 bp, Arabidopsis thaliana
ttgagagaagagagtgtgtg

SEQ ID NO: 3391 - DNA, 18 bp, Arabidopsis thaliana
ctgcagctgcggctgctg

SEQ ID NO: 3392 - DNA, 23 bp, Arabidopsis thaliana
tgttcttgtggtttcttaggaag

SEQ ID NO: 3393 - DNA, 18 bp, Arabidopsis thaliana
ctgctgctgctggtggtg

SEQ ID NO: 3394 - DNA, 21 bp, Arabidopsis thaliana
tcaacttcaacatcatctcca

SEQ ID NO: 3395 - DNA, 21 bp, Arabidopsis thaliana
tgaggatattgttagaggtgt

SEQ ID NO: 3396 - DNA, 21 bp, Arabidopsis thaliana
aagctgatggatgttttcctc

SEQ ID NO: 3397 - DNA, 22 bp, Arabidopsis thaliana
atgactcttcttcttcttcttc

SEQ ID NO: 3398 - DNA, 21 bp, Arabidopsis thaliana
acacgttgcagattcttcatt

SEQ ID NO: 3399 - DNA, 20 bp, Arabidopsis thaliana
ggtgcggctgctgctgctgg

SEQ ID NO: 3400 - DNA, 18 bp, Arabidopsis thaliana
aatcctagctagctaggt

SEQ ID NO: 3401 - DNA, 18 bp, Arabidopsis thaliana
atgcgatgtttgcgcttc

SEQ ID NO: 3402 - DNA, 18 bp, Arabidopsis thaliana
atcagttcaactttgaga

SEQ ID NO: 3403 - DNA, 22 bp, Arabidopsis thaliana
aaagtggaagctctgactgcat

SEQ ID NO: 3404 - DNA, 21 bp, Arabidopsis thaliana
ggtttgtacgtacactgttca

SEQ ID NO: 3405 - DNA, 19 bp, Arabidopsis thaliana
tcactctctctctatctct

SEQ ID NO: 3406 - DNA, 18 bp, Arabidopsis thaliana
tggttgttgttgctgctg

SEQ ID NO: 3407 - DNA, 18 bp, Arabidopsis thaliana
ttgatgtgagagcttgag

SEQ ID NO: 3408 - DNA, 20 bp, Arabidopsis thaliana
tgatgaagttgattggttaa

SEQ ID NO: 3409 - DNA, 21 bp, Arabidopsis thaliana
aagctttgctcgttcatgttc

SEQ ID NO: 3410 - DNA, 23 bp, Arabidopsis thaliana
atctggaggtatgatcctggatt

SEQ ID NO: 3411 - DNA, 19 bp, Arabidopsis thaliana
ttctctttggttttgactg

SEQ ID NO: 3412 - DNA, 18 bp, Arabidopsis thaliana
agtagcaccatgaaactg

SEQ ID NO: 3413 - DNA, 23 bp, Arabidopsis thaliana
ttgacagaagatagagagcacag

SEQ ID NO: 3414 - DNA, 20 bp, Arabidopsis thaliana
actcctttgtgtatgtgttc

SEQ ID NO: 3415 - DNA, 19 bp, Arabidopsis thaliana
tgattctacttcttcttca

SEQ ID NO: 3416 - DNA, 21 bp, Arabidopsis thaliana
atgcaggtgaagaagctggct

SEQ ID NO: 3417 - DNA, 23 bp, Arabidopsis thaliana
tgagagagtcacagagagagaga

SEQ ID NO: 3418 - DNA, 18 bp, Arabidopsis thaliana
ttgaaattcttgtttgat

SEQ ID NO: 3419 - DNA, 23 bp, Arabidopsis thaliana
tagttcttgttgttgtcatgcag

SEQ ID NO: 3420 - DNA, 21 bp, Arabidopsis thaliana
atgtgtcaatgtttgttttag

SEQ ID NO: 3421 - DNA, 20 bp, Arabidopsis thaliana
tggaagaagattgtggtgct

SEQ ID NO: 3422 - DNA, 18 bp, Arabidopsis thaliana
tgtgtgtttgtgtgtatg

SEQ ID NO: 3423 - DNA, 22 bp, Arabidopsis thaliana
ctgcaacaggtgctgaaggtgc

SEQ ID NO: 3424 - DNA, 22 bp, Arabidopsis thaliana
tcattggtcttcaaggtgaatg

SEQ ID NO: 3425 - DNA, 23 bp, Arabidopsis thaliana
tggtggcggtgatggcgatggtg

SEQ ID NO: 3426 - DNA, 21 bp, Arabidopsis thaliana
ttctggtagatgatgatgatg

SEQ ID NO: 3427 - DNA, 22 bp, Arabidopsis thaliana
tatacatacacatagacataag

SEQ ID NO: 3428 - DNA, 22 bp, Arabidopsis thaliana
tctttctgtcatgaaatgttct

SEQ ID NO: 3429 - DNA, 19 bp, Arabidopsis thaliana
tgtagaaaaatgtggatgt

SEQ ID NO: 3430 - DNA, 22 bp, Arabidopsis thaliana
aatcttgttggtggtgaagaca

SEQ ID NO: 3431 - DNA, 20 bp, Arabidopsis thaliana
acgaggaagaagatgaagaa

SEQ ID NO: 3432 - DNA, 19 bp, Arabidopsis thaliana
tttcttgttcttgctcatc

SEQ ID NO: 3433 - DNA, 21 bp, Arabidopsis thaliana
ctgaagtgtttggggggactc

SEQ ID NO: 3434 - DNA, 20 bp, Arabidopsis thaliana
acacggtgagattttgttat

SEQ ID NO: 3435 - DNA, 21 bp, Arabidopsis thaliana
ttcagagacgtattgttcttc

SEQ ID NO: 3436 - DNA, 18 bp, Arabidopsis thaliana
aacaatgatgcagcagtt

SEQ ID NO: 3437 - DNA, 19 bp, Arabidopsis thaliana
gtgccgatgcagctggtgg

SEQ ID NO: 3438 - DNA, 19 bp, Arabidopsis thaliana
aggcatgctgctgctgcag

SEQ ID NO: 3439 - DNA, 18 bp, Arabidopsis thaliana
aactgttcttttgatgat

SEQ ID NO: 3440 - DNA, 21 bp, Arabidopsis thaliana
aaatcagtgtgtatttgttaa

SEQ ID NO: 3441 - DNA, 22 bp, Arabidopsis thaliana
tacgcattgagtttcgttgctt

SEQ ID NO: 3442 - DNA, 23 bp, Arabidopsis thaliana
aagaattgatgttgttggtgcag

SEQ ID NO: 3443 - DNA, 19 bp, Arabidopsis thaliana
acctcagtgtatttgttga

SEQ ID NO: 3444 - DNA, 21 bp, Arabidopsis thaliana
tgaatatggatgttaatgtga

SEQ ID NO: 3445 - DNA, 20 bp, Arabidopsis thaliana
aggatgatgatgaaggtgtt

SEQ ID NO: 3446 - DNA, 19 bp, Arabidopsis thaliana
aggaggaggagcagcagca

SEQ ID NO: 3447 - DNA, 23 bp, Arabidopsis thaliana
agacagagagatttctgtttgtg

SEQ ID NO: 3448 - DNA, 21 bp, Arabidopsis thaliana
ttatgtcttgatcttgtgatt

SEQ ID NO: 3449 - DNA, 21 bp, Arabidopsis thaliana
attgagagttgagtctgtaga

SEQ ID NO: 3450 - DNA, 20 bp, Arabidopsis thaliana
ttgatcatgaagaagaagat

SEQ ID NO: 3451 - DNA, 19 bp, Arabidopsis thaliana
tgtatcatcttcgtcgtca

SEQ ID NO: 3452 - DNA, 19 bp, Arabidopsis thaliana
gctggtttgttggttctga

SEQ ID NO: 3453 - DNA, 18 bp, Arabidopsis thaliana
tcactgattttgcaagtg

SEQ ID NO: 3454 - DNA, 19 bp, Arabidopsis thaliana
ttgtgtctctgtttctcaa

SEQ ID NO: 3455 - DNA, 18 bp, Arabidopsis thaliana
acatcacctgcacctgga

SEQ ID NO: 3456 - DNA, 23 bp, Arabidopsis thaliana
ggaactgctgctggagctgggag

SEQ ID NO: 3457 - DNA, 20 bp, Arabidopsis thaliana
tgaagctgtgatagctgaga

SEQ ID NO: 3458 - DNA, 19 bp, Arabidopsis thaliana
aatgtgcatgcttatattt

SEQ ID NO: 3459 - DNA, 23 bp, Arabidopsis thaliana
tgagtttgttgtttgaaatgtca

SEQ ID NO: 3460 - DNA, 18 bp, Arabidopsis thaliana
tgtttgttgttgttgcaa

SEQ ID NO: 3461 - DNA, 20 bp, Arabidopsis thaliana
aggtagtttgttgcattgtt

SEQ ID NO: 3462 - DNA, 23 bp, Arabidopsis thaliana
catcagcagctgcagctgcggcg

SEQ ID NO: 3463 - DNA, 23 bp, Arabidopsis thaliana
ggagtcgatttcttttgttgatc

SEQ ID NO: 3464 - DNA, 23 bp, Arabidopsis thaliana
gtctctggtcttcttcttcagtc

SEQ ID NO: 3465 - DNA, 22 bp, Arabidopsis thaliana
tgaatgtgtgtgtgtatgtgtg

SEQ ID NO: 3466 - DNA, 20 bp, Arabidopsis thaliana
aaactgtgtgtgtatgtaga

SEQ ID NO: 3467 - DNA, 19 bp, Arabidopsis thaliana
ctcggcgccgccgctgcgc

SEQ ID NO: 3468 - DNA, 21 bp, Arabidopsis thaliana
agtcatgagacgatgttgttg

SEQ ID NO: 3469 - DNA, 21 bp, Arabidopsis thaliana
tgtttccatttgttggtctgt

SEQ ID NO: 3470 - DNA, 21 bp, Arabidopsis thaliana
ttttcttctacttcttgcaca

SEQ ID NO: 3471 - DNA, 20 bp, Arabidopsis thaliana
ttggcattctgtccacctcc

SEQ ID NO: 3472 - DNA, 23 bp, Arabidopsis thaliana
tctctctctaactctaagacaca

SEQ ID NO: 3473 - DNA, 20 bp, Arabidopsis thaliana
aagtgtagagtttatgtaga

SEQ ID NO: 3474 - DNA, 18 bp, Arabidopsis thaliana
tcttcatcatcatcatca

SEQ ID NO: 3475 - DNA, 20 bp, Arabidopsis thaliana
tgactttgtgtgtgtttgac

SEQ ID NO: 3476 - DNA, 18 bp, Arabidopsis thaliana
aatgttgttgttgcaggt

SEQ ID NO: 3477 - DNA, 20 bp, Arabidopsis thaliana
catcagcagcagcagcagca

SEQ ID NO: 3478 - DNA, 19 bp, Arabidopsis thaliana
tgcacactcttgtagctgt

SEQ ID NO: 3479 - DNA, 23 bp, Arabidopsis thaliana
cgaagatcttgatgatgatgatg

SEQ ID NO: 3480 - DNA, 23 bp, Arabidopsis thaliana
ttgagtgttctgttgttgctgac

SEQ ID NO: 3481 - DNA, 21 bp, Arabidopsis thaliana
actattatgatgatgatcctg

SEQ ID NO: 3482 - DNA, 20 bp, Arabidopsis thaliana
aggttgttgatgatgcttca

SEQ ID NO: 3483 - DNA, 22 bp, Arabidopsis thaliana
ttttttgttgttgttgcagaaa

SEQ ID NO: 3484 - DNA, 21 bp, Arabidopsis thaliana
tttgtgatgtgatgctaattt

SEQ ID NO: 3485 - DNA, 19 bp, Arabidopsis thaliana
tttggtcatatatatccat

SEQ ID NO: 3486 - DNA, 21 bp, Arabidopsis thaliana
aactgcaaacagtagttccac

SEQ ID NO: 3487 - DNA, 20 bp, Arabidopsis thaliana
ttcgatgtctagcagtgcca

SEQ ID NO: 3488 - DNA, 18 bp, Arabidopsis thaliana
acgatgatgatgatgatg

SEQ ID NO: 3489 - DNA, 22 bp, Arabidopsis thaliana
tgtttgttgtactcggtctagt

SEQ ID NO: 3490 - DNA, 22 bp, Arabidopsis thaliana
tagaccgatgtcaacaaacaag

SEQ ID NO: 3491 - DNA, 21 bp, Arabidopsis thaliana
ttgccatttttgttgttggta

SEQ ID NO: 3492 - DNA, 23 bp, Arabidopsis thaliana
atgttttacatgcatgttcttgt

SEQ ID NO: 3493 - DNA, 23 bp, Arabidopsis thaliana
tttcatggtgtgtgtgtgtgact

SEQ ID NO: 3494 - DNA, 19 bp, Arabidopsis thaliana
ctcagatgatactcaccac

SEQ ID NO: 3495 - DNA, 21 bp, Arabidopsis thaliana
atctctctcttcatcttcttg

SEQ ID NO: 3496 - DNA, 18 bp, Arabidopsis thaliana
tttctctgttgatggtgt

SEQ ID NO: 3497 - DNA, 21 bp, Arabidopsis thaliana
tgtgtctgtctgtatttgatg

SEQ ID NO: 3498 - DNA, 22 bp, Arabidopsis thaliana
atggtgatcatgatcattgttg

SEQ ID NO: 3499 - DNA, 23 bp, Arabidopsis thaliana
tgatgatgatgatgatcttgctc

SEQ ID NO: 3500 - DNA, 23 bp, Arabidopsis thaliana
attgctctcttcttcatgttctt

SEQ ID NO: 3501 - DNA, 21 bp, Arabidopsis thaliana
tctttgctcttcttcttcagc

SEQ ID NO: 3502 - DNA, 18 bp, Arabidopsis thaliana
gtgactgttgaggagctg

SEQ ID NO: 3503 - DNA, 21 bp, Arabidopsis thaliana
tgtggttcttgtttcagctct

SEQ ID NO: 3504 - DNA, 18 bp, Arabidopsis thaliana
tgactttggtgtttgtgt

SEQ ID NO: 3505 - DNA, 19 bp, Arabidopsis thaliana
ggaggccgcggctgctggc

SEQ ID NO: 3506 - DNA, 23 bp, Arabidopsis thaliana
tagacatcttgatcatgttgttg

SEQ ID NO: 3507 - DNA, 20 bp, Arabidopsis thaliana
tgtatagattggagtttcat

SEQ ID NO: 3508 - DNA, 18 bp, Arabidopsis thaliana
tatgttcttgatgttgct

SEQ ID NO: 3509 - DNA, 18 bp, Arabidopsis thaliana
tggaagaatcttcttttg

SEQ ID NO: 3510 - DNA, 21 bp, Arabidopsis thaliana
atctgaagagattattttgag

SEQ ID NO: 3511 - DNA, 19 bp, Arabidopsis thaliana
tgaaggttctccttgtttt

SEQ ID NO: 3512 - DNA, 18 bp, Arabidopsis thaliana
tggtatgttagttccact

SEQ ID NO: 3513 - DNA, 19 bp, Arabidopsis thaliana
agcctctttttggctatgt

SEQ ID NO: 3514 - DNA, 20 bp, Arabidopsis thaliana
tcacacacatgtgttggcag

SEQ ID NO: 3515 - DNA, 19 bp, Arabidopsis thaliana
tgaattgatgatgaagatg

SEQ ID NO: 3516 - DNA, 19 bp, Arabidopsis thaliana
tctcctcttcatcttcttc

SEQ ID NO: 3517 - DNA, 19 bp, Arabidopsis thaliana
tgaagactttggcacagat

SEQ ID NO: 3518 - DNA, 19 bp, Arabidopsis thaliana
gagattgaagatgatgatg

SEQ ID NO: 3519 - DNA, 23 bp, Arabidopsis thaliana
atcatcctcttcatcgtcatctt

SEQ ID NO: 3520 - DNA, 18 bp, Arabidopsis thaliana
aaacgtcatcttcatcat

SEQ ID NO: 3521 - DNA, 18 bp, Arabidopsis thaliana
agtgttgttgctcctgga

SEQ ID NO: 3522 - DNA, 23 bp, Arabidopsis thaliana
agagagaagagtttgagcagttg

SEQ ID NO: 3523 - DNA, 20 bp, Arabidopsis thaliana
attcattgttcttgaagtgt

SEQ ID NO: 3524 - DNA, 22 bp, Arabidopsis thaliana
tatgtgtgtgtgcatgtgtata

SEQ ID NO: 3525 - DNA, 19 bp, Arabidopsis thaliana
tgtctcggtctcgttgtca

SEQ ID NO: 3526 - DNA, 21 bp, Arabidopsis thaliana
tttcacagtggttatgtgtca

SEQ ID NO: 3527 - DNA, 23 bp, Arabidopsis thaliana
tggtgctcgtgctgctgctgctg

SEQ ID NO: 3528 - DNA, 23 bp, Arabidopsis thaliana
tcatcatcatcatcatcatcatc

SEQ ID NO: 3529 - DNA, 19 bp, Arabidopsis thaliana
actctcttcttcttcctca

SEQ ID NO: 3530 - DNA, 21 bp, Arabidopsis thaliana
ttcttcttcatctagttccac

SEQ ID NO: 3531 - DNA, 18 bp, Arabidopsis thaliana
tgtggaaagctttgagag

SEQ ID NO: 3532 - DNA, 20 bp, Arabidopsis thaliana
atttagggttttggtgtaga

SEQ ID NO: 3533 - DNA, 23 bp, Arabidopsis thaliana
ttttgatgaagattcttgcttga

SEQ ID NO: 3534 - DNA, 18 bp, Arabidopsis thaliana
tgagtgtgtgtttgctga

SEQ ID NO: 3535 - DNA, 23 bp, Arabidopsis thaliana
tggcttcttgttcttcatcctct

SEQ ID NO: 3536 - DNA, 23 bp, Arabidopsis thaliana
ataactcttcttcttcttcgtgt

SEQ ID NO: 3537 - DNA, 22 bp, Arabidopsis thaliana
tttgtctctgatgatgttggtc

SEQ ID NO: 3538 - DNA, 20 bp, Arabidopsis thaliana
gtctgctcttcttcttcatc

SEQ ID NO: 3539 - DNA, 21 bp, Arabidopsis thaliana
ttcttcttcttctacttctag

SEQ ID NO: 3540 - DNA, 23 bp, Arabidopsis thaliana
agtgtgtgtgagtgtgactgtgt

SEQ ID NO: 3541 - DNA, 22 bp, Arabidopsis thaliana
tgatcttgaagttgaagatgaa

SEQ ID NO: 3542 - DNA, 19 bp, Arabidopsis thaliana
aatcaaacacatgctctgt

SEQ ID NO: 3543 - DNA, 21 bp, Arabidopsis thaliana
tgttttgtgttcatgttgatg

SEQ ID NO: 3544 - DNA, 21 bp, Arabidopsis thaliana
atgtctatgctgatgatgatg

SEQ ID NO: 3545 - DNA, 23 bp, Arabidopsis thaliana
atgatgaagaagaagaagatgat

SEQ ID NO: 3546 - DNA, 18 bp, Arabidopsis thaliana
cagcacttgttgcagcag

SEQ ID NO: 3547 - DNA, 22 bp, Arabidopsis thaliana
tcttttttgctgctgatgatgt

SEQ ID NO: 3548 - DNA, 20 bp, Arabidopsis thaliana
tgagtgagctttttgttgtg

SEQ ID NO: 3549 - DNA, 21 bp, Arabidopsis thaliana
gagtcatcatcatcatcatca

SEQ ID NO: 3550 - DNA, 20 bp, Arabidopsis thaliana
tatttgttgatgatgcagtt

SEQ ID NO: 3551 - DNA, 21 bp, Arabidopsis thaliana
tcatcttcatcatcatcagga

SEQ ID NO: 3552 - DNA, 19 bp, Arabidopsis thaliana
tggtttagatatgttgatg

SEQ ID NO: 3553 - DNA, 23 bp, Arabidopsis thaliana
tggaagaatgttgttttcctacg

SEQ ID NO: 3554 - DNA, 22 bp, Arabidopsis thaliana
agttgttgttgttgctgctgct

SEQ ID NO: 3555 - DNA, 22 bp, Arabidopsis thaliana
tgcagtttcatgttcctcttct

SEQ ID NO: 3556 - DNA, 18 bp, Arabidopsis thaliana
gctctgataccaaatata

SEQ ID NO: 3557 - DNA, 20 bp, Arabidopsis thaliana
tggaagagagttggatgtgt

SEQ ID NO: 3558 - DNA, 19 bp, Arabidopsis thaliana
tatgtagtagattgtatat

SEQ ID NO: 3559 - DNA, 23 bp, Arabidopsis thaliana
tggagcaggtgtagcagcaggtg

SEQ ID NO: 3560 - DNA, 19 bp, Arabidopsis thaliana
tcttagctattcatagtgt

SEQ ID NO: 3561 - DNA, 22 bp, Arabidopsis thaliana
tctgctgcagctgctgctgcag

SEQ ID NO: 3562 - DNA, 21 bp, Arabidopsis thaliana
acagcttctacaacttggaca

SEQ ID NO: 3563 - DNA, 22 bp, Arabidopsis thaliana
aagcagcatttgaaaaatgtgt

SEQ ID NO: 3564 - DNA, 23 bp, Arabidopsis thaliana
agtgtgactgtgtgagtgcatgc

SEQ ID NO: 3565 - DNA, 20 bp, Arabidopsis thaliana
ctgagctagagaatgtctgt

SEQ ID NO: 3566 - DNA, 18 bp, Arabidopsis thaliana
ttggctctagttgggtat

SEQ ID NO: 3567 - DNA, 19 bp, Arabidopsis thaliana
caacactaatgatgatgct

SEQ ID NO: 3568 - DNA, 21 bp, Arabidopsis thaliana
atcagtttcttgttcgtttca

SEQ ID NO: 3569 - DNA, 21 bp, Arabidopsis thaliana
aaacgaacaaaaaactgatgg

SEQ ID NO: 3570 - DNA, 19 bp, Arabidopsis thaliana
cagctgatgatgctggtgt

SEQ ID NO: 3571 - DNA, 20 bp, Arabidopsis thaliana
aagacacgtgatgttgttgt

SEQ ID NO: 3572 - DNA, 21 bp, Arabidopsis thaliana
tcaggtatgattgacttcaaa

SEQ ID NO: 3573 - DNA, 22 bp, Arabidopsis thaliana
taaagtcaataataccttgaag

SEQ ID NO: 3574 - DNA, 19 bp, Arabidopsis thaliana
ttgcttgaagattctgcat

SEQ ID NO: 3575 - DNA, 18 bp, Arabidopsis thaliana
acctccgtctctctctct

SEQ ID NO: 3576 - DNA, 22 bp, Arabidopsis thaliana
gtgttagttgttgttgctgtat

SEQ ID NO: 3577 - DNA, 19 bp, Arabidopsis thaliana
atgagcattaagtggagga

SEQ ID NO: 3578 - DNA, 22 bp, Arabidopsis thaliana
tgtgatctctcatcttcttgtc

SEQ ID NO: 3579 - DNA, 18 bp, Arabidopsis thaliana
ttggtttgattttgtagc

SEQ ID NO: 3580 - DNA, 22 bp, Arabidopsis thaliana
tggtatgtcatgaaataaggaa

SEQ ID NO: 3581 - DNA, 20 bp, Arabidopsis thaliana
ttggcattctgtccacctcc

SEQ ID NO: 3582 - DNA, 21 bp, Arabidopsis thaliana
tttgcttgtttttcttcacat

SEQ ID NO: 3583 - DNA, 20 bp, Arabidopsis thaliana
aatcttgatgatgatgggtt

SEQ ID NO: 3584 - DNA, 21 bp, Arabidopsis thaliana
aaagacaccaatcactgaaga

SEQ ID NO: 3585 - DNA, 23 bp, Arabidopsis thaliana
aagctgctgctgctgctccagtg

SEQ ID NO: 3586 - DNA, 21 bp, Arabidopsis thaliana
ttagagttttctggatactta

SEQ ID NO: 3587 - DNA, 21 bp, Arabidopsis thaliana
tcattgtgtatctgtgtgtgt

SEQ ID NO: 3588 - DNA, 23 bp, Arabidopsis thaliana
ttctttggtggtggtggggaatg

SEQ ID NO: 3589 - DNA, 18 bp, Arabidopsis thaliana
ttctgatgttgattcttc

SEQ ID NO: 3590 - DNA, 23 bp, Arabidopsis thaliana
tcagtggatttgttcttgatgat

SEQ ID NO: 3591 - DNA, 21 bp, Arabidopsis thaliana
atcagcagtttcttcaggcaa

SEQ ID NO: 3592 - DNA, 21 bp, Arabidopsis thaliana
tgattgttgtacaagttgctg

SEQ ID NO: 3593 - DNA, 23 bp, Arabidopsis thaliana
tgagtgtaaaatgtgtgtagatc

SEQ ID NO: 3594 - DNA, 20 bp, Arabidopsis thaliana
tcagtcttgagttgctgcag

SEQ ID NO: 3595 - DNA, 20 bp, Arabidopsis thaliana
atgtagtatgatggatgtgt

SEQ ID NO: 3596 - DNA, 19 bp, Arabidopsis thaliana
agagagttgttggtgttga

SEQ ID NO: 3597 - DNA, 20 bp, Arabidopsis thaliana
tgaggaatgtttctgctgtg

SEQ ID NO: 3598 - DNA, 19 bp, Arabidopsis thaliana
tggcggtgaatttgtagga

SEQ ID NO: 3599 - DNA, 20 bp, Arabidopsis thaliana
tcttcttcgtcgtcgtcgtc

SEQ ID NO: 3600 - DNA, 21 bp, Arabidopsis thaliana
gtgttgtgtgttgcactttct

SEQ ID NO: 3601 - DNA, 19 bp, Arabidopsis thaliana
ttgagaggattgttgaact

SEQ ID NO: 3602 - DNA, 22 bp, Arabidopsis thaliana
ggtttggtgtttgatgttcctg

SEQ ID NO: 3603 - DNA, 18 bp, Arabidopsis thaliana
tgtgattgtgtttcttct

SEQ ID NO: 3604 - DNA, 21 bp, Arabidopsis thaliana
tggtcattgttgttgttgcta

SEQ ID NO: 3605 - DNA, 19 bp, Arabidopsis thaliana
aagcttttgcatctgttta

SEQ ID NO: 3606 - DNA, 18 bp, Arabidopsis thaliana
caaggtcatcatcctcat

SEQ ID NO: 3607 - DNA, 23 bp, Arabidopsis thaliana
gagaagagagtgaggcaaagaag

SEQ ID NO: 3608 - DNA, 19 bp, Arabidopsis thaliana
ctgcttctttctgtctcac

SEQ ID NO: 3609 - DNA, 20 bp, Arabidopsis thaliana
tgtgcaaagttttaatcttt

SEQ ID NO: 3610 - DNA, 18 bp, Arabidopsis thaliana
aatgtgggtaatgtatgt

SEQ ID NO: 3611 - DNA, 18 bp, Arabidopsis thaliana
aacttcttcatcttcttg

SEQ ID NO: 3612 - DNA, 18 bp, Arabidopsis thaliana
atcttgaagaagatgaag

SEQ ID NO: 3613 - DNA, 23 bp, Arabidopsis thaliana
ttgtatttggttctcattgaatt

SEQ ID NO: 3614 - DNA, 19 bp, Arabidopsis thaliana
ttctttcttgttggtctct

SEQ ID NO: 3615 - DNA, 21 bp, Arabidopsis thaliana
tatggttgtacatagtgccta

SEQ ID NO: 3616 - DNA, 19 bp, Arabidopsis thaliana
tgtggaaggatatagagtg

SEQ ID NO: 3617 - DNA, 19 bp, Arabidopsis thaliana
atgagatgatcatctctgc

SEQ ID NO: 3618 - DNA, 19 bp, Arabidopsis thaliana
tgtgttctcatgttgttca

SEQ ID NO: 3619 - DNA, 21 bp, Arabidopsis thaliana
ctgaagtgtttggggggactc

SEQ ID NO: 3620 - DNA, 21 bp, Arabidopsis thaliana
ctgaagtgtttggggggactc

SEQ ID NO: 3621 - DNA, 19 bp, Arabidopsis thaliana
tgcagactacactgttggt

SEQ ID NO: 3622 - DNA, 18 bp, Arabidopsis thaliana
tatcttgatgatactgca

SEQ ID NO: 3623 - DNA, 20 bp, Arabidopsis thaliana
agttctttctctgctgctgc

SEQ ID NO: 3624 - DNA, 20 bp, Arabidopsis thaliana
taagtagttttatgttcatg

SEQ ID NO: 3625 - DNA, 20 bp, Arabidopsis thaliana
atctcaggatacttgtttga

SEQ ID NO: 3626 - DNA, 19 bp, Arabidopsis thaliana
tttgcttgattttgatgca

SEQ ID NO: 3627 - DNA, 23 bp, Arabidopsis thaliana
taagactgtctgcttaggttcaa

SEQ ID NO: 3628 - DNA, 21 bp, Arabidopsis thaliana
ttgtttgctcatttagttgat

SEQ ID NO: 3629 - DNA, 22 bp, Arabidopsis thaliana
tgaccatgaagaagaagaagaa

SEQ ID NO: 3630 - DNA, 21 bp, Arabidopsis thaliana
ttgtcattgttcttgatgtca

SEQ ID NO: 3631 - DNA, 19 bp, Arabidopsis thaliana
agcatgttgatgatgatga

SEQ ID NO: 3632 - DNA, 18 bp, Arabidopsis thaliana
tcgtgaagaagaagaaga

SEQ ID NO: 3633 - DNA, 23 bp, Arabidopsis thaliana
cagctgcacctacaggaagctct

SEQ ID NO: 3634 - DNA, 23 bp, Arabidopsis thaliana
tggtgaatcaagatgatgatgtt

SEQ ID NO: 3635 - DNA, 23 bp, Arabidopsis thaliana
tgcatctgcatctgtgtgggact

SEQ ID NO: 3636 - DNA, 21 bp, Arabidopsis thaliana
aagctgagtctcctgatgaag

SEQ ID NO: 3637 - DNA, 20 bp, Arabidopsis thaliana
aatgttgttgttggatcttt

SEQ ID NO: 3638 - DNA, 20 bp, Arabidopsis thaliana
tgtgttatgtgtatgtgtac

SEQ ID NO: 3639 - DNA, 20 bp, Arabidopsis thaliana
tgtgttatgtgtatgtgtac

SEQ ID NO: 3640 - DNA, 18 bp, Arabidopsis thaliana
tgtgaatgatgaacgtga

SEQ ID NO: 3641 - DNA, 23 bp, Arabidopsis thaliana
cgacttcttcatcgtcatcgtca

SEQ ID NO: 3642 - DNA, 21 bp, Arabidopsis thaliana
gagccaaggatgacttgccga

SEQ ID NO: 3643 - DNA, 18 bp, Arabidopsis thaliana
ttctctgtgcctgttgtt

SEQ ID NO: 3644 - DNA, 23 bp, Arabidopsis thaliana
tcatcttcttcatcatcactcac

SEQ ID NO: 3645 - DNA, 22 bp, Arabidopsis thaliana
atgacagaagagagagagcaga

SEQ ID NO: 3646 - DNA, 18 bp, Arabidopsis thaliana
actcatgtacatgcactt

SEQ ID NO: 3647 - DNA, 21 bp, Arabidopsis thaliana
catcatcatcatcttcatcat

SEQ ID NO: 3648 - DNA, 22 bp, Arabidopsis thaliana
tatgatgattgatgatgatcga

SEQ ID NO: 3649 - DNA, 21 bp, Arabidopsis thaliana
ttagtgaatgtttgtataagt

SEQ ID NO: 3650 - DNA, 21 bp, Arabidopsis thaliana
tcttgcaaatcttcttctcca

SEQ ID NO: 3651 - DNA, 20 bp, Arabidopsis thaliana
agaagaagaagacgaagaag

SEQ ID NO: 3652 - DNA, 19 bp, Arabidopsis thaliana
aaaatggagttcttattca

SEQ ID NO: 3653 - DNA, 18 bp, Arabidopsis thaliana
ttgatgtactacaagaag

SEQ ID NO: 3654 - DNA, 19 bp, Arabidopsis thaliana
tttgatgtactacaagaag

SEQ ID NO: 3655 - DNA, 23 bp, Arabidopsis thaliana
gagtctgcttcttcttctgcttc

SEQ ID NO: 3656 - DNA, 20 bp, Arabidopsis thaliana
tcttgtgttcttgatgtgac

SEQ ID NO: 3657 - DNA, 19 bp, Arabidopsis thaliana
ttacatgaagattgtgagt

SEQ ID NO: 3658 - DNA, 22 bp, Arabidopsis thaliana
atgggagtggatggcaatgtgt

SEQ ID NO: 3659 - DNA, 20 bp, Arabidopsis thaliana
tcatgtgagcatcttgtcac

SEQ ID NO: 3660 - DNA, 21 bp, Arabidopsis thaliana
ttgtgcttgatctatgtctct

SEQ ID NO: 3661 - DNA, 23 bp, Arabidopsis thaliana
tagattgtttattgatgttgatg

SEQ ID NO: 3662 - DNA, 23 bp, Arabidopsis thaliana
actgaattgttgttgctgctgct

SEQ ID NO: 3663 - DNA, 19 bp, Arabidopsis thaliana
ttcttcttcttcttcgtaa

SEQ ID NO: 3664 - DNA, 21 bp, Arabidopsis thaliana
acatgtttgtgagcaggtact

SEQ ID NO: 3665 - DNA, 23 bp, Arabidopsis thaliana
gattcgtcttgttgttgctgcag

SEQ ID NO: 3666 - DNA, 22 bp, Arabidopsis thaliana
gatgtgtgtgttaatgtacgat

SEQ ID NO: 3667 - DNA, 22 bp, Arabidopsis thaliana
atctttcattttcatggatgtt

SEQ ID NO: 3668 - DNA, 20 bp, Arabidopsis thaliana
tatggaggagtttcttgatg

SEQ ID NO: 3669 - DNA, 19 bp, Arabidopsis thaliana
atgtggcaggtattgataa

SEQ ID NO: 3670 - DNA, 18 bp, Arabidopsis thaliana
ttgatcttgatgatgctg

SEQ ID NO: 3671 - DNA, 18 bp, Arabidopsis thaliana
tatgtacattttgttgtt

SEQ ID NO: 3672 - DNA, 19 bp, Arabidopsis thaliana
tctattgttgttggtttcc

SEQ ID NO: 3673 - DNA, 21 bp, Arabidopsis thaliana
gctttgtgttgttgcagacta

SEQ ID NO: 3674 - DNA, 21 bp, Arabidopsis thaliana
tttgtgagcttgaccaccagg

SEQ ID NO: 3675 - DNA, 23 bp, Arabidopsis thaliana
ctgctcatcgtcatcgtcatcat

SEQ ID NO: 3676 - DNA, 20 bp, Arabidopsis thaliana
catgagactgattcgtcatg

SEQ ID NO: 3677 - DNA, 21 bp, Arabidopsis thaliana
taaatgtctgcatgtatatgg

SEQ ID NO: 3678 - DNA, 21 bp, Arabidopsis thaliana
ttattcattgtttctagttgt

SEQ ID NO: 3679 - DNA, 21 bp, Arabidopsis thaliana
cattggttttgaagctgatag

SEQ ID NO: 3680 - DNA, 18 bp, Arabidopsis thaliana
tgtggttcttgaaagctt

SEQ ID NO: 3681 - DNA, 23 bp, Arabidopsis thaliana
ctggagcagcagctgctgctgga

SEQ ID NO: 3682 - DNA, 21 bp, Arabidopsis thaliana
cgaaaagaggtattttggatg

SEQ ID NO: 3683 - DNA, 18 bp, Arabidopsis thaliana
ttctgctgctgttgtagc

SEQ ID NO: 3684 - DNA, 19 bp, Arabidopsis thaliana
tctggttcttctttgaagt

SEQ ID NO: 3685 - DNA, 23 bp, Arabidopsis thaliana
tctttggttgctgaggatgatga

SEQ ID NO: 3686 - DNA, 19 bp, Arabidopsis thaliana
cgtccacttcttgttcttc

SEQ ID NO: 3687 - DNA, 23 bp, Arabidopsis thaliana
agtgtgcaagtgtgtgtgtgtct

SEQ ID NO: 3688 - DNA, 20 bp, Arabidopsis thaliana
aatgtatgcatgtatgtatg

SEQ ID NO: 3689 - DNA, 18 bp, Arabidopsis thaliana
aagacttttgtttatgtt

SEQ ID NO: 3690 - DNA, 21 bp, Arabidopsis thaliana
tctttcattgttgcatgtgct

SEQ ID NO: 3691 - DNA, 20 bp, Arabidopsis thaliana
taggctatgttgttgttgta

SEQ ID NO: 3692 - DNA, 20 bp, Arabidopsis thaliana
ttagcacttcttgatgttga

SEQ ID NO: 3693 - DNA, 22 bp, Arabidopsis thaliana
cattgagcaaggtgtctctgtt

SEQ ID NO: 3694 - DNA, 18 bp, Arabidopsis thaliana
acattggctgtggtgtgg

SEQ ID NO: 3695 - DNA, 20 bp, Arabidopsis thaliana
tctggtgttgttatagttct

SEQ ID NO: 3696 - DNA, 23 bp, Arabidopsis thaliana
tttgttgtcagttcttgaactct

SEQ ID NO: 3697 - DNA, 18 bp, Arabidopsis thaliana
aagagagaggttagagag

SEQ ID NO: 3698 - DNA, 22 bp, Arabidopsis thaliana
aggagtgtgtggatcgacactc

SEQ ID NO: 3699 - DNA, 19 bp, Arabidopsis thaliana
aagagagaggttagagaga

SEQ ID NO: 3700 - DNA, 23 bp, Arabidopsis thaliana
gtaatgctcagacaggttggaga

SEQ ID NO: 3701 - DNA, 19 bp, Arabidopsis thaliana
ccttgttgttgctgtggag

SEQ ID NO: 3702 - DNA, 18 bp, Arabidopsis thaliana
ttgttgttgatgtagctg

SEQ ID NO: 3703 - DNA, 20 bp, Arabidopsis thaliana
tggtagagtgatgatcaggt

SEQ ID NO: 3704 - DNA, 21 bp, Arabidopsis thaliana
gaaagactgatgaggatgatg

SEQ ID NO: 3705 - DNA, 18 bp, Arabidopsis thaliana
tcttcgtcatcttcttgt

SEQ ID NO: 3706 - DNA, 23 bp, Arabidopsis thaliana
tcatcatcatcatcaagatcttc

SEQ ID NO: 3707 - DNA, 23 bp, Arabidopsis thaliana
caggtcattgtagttgcattcca

SEQ ID NO: 3708 - DNA, 18 bp, Arabidopsis thaliana
ttgttgttgatgtagctg

SEQ ID NO: 3709 - DNA, 22 bp, Arabidopsis thaliana
gaatgatgatggtgatacttga

SEQ ID NO: 3710 - DNA, 18 bp, Arabidopsis thaliana
ttgttgttgatgtagctg

SEQ ID NO: 3711 - DNA, 18 bp, Arabidopsis thaliana
aagagctaaggaaaagga

SEQ ID NO: 3712 - DNA, 20 bp, Arabidopsis thaliana
ttggttttgaagttgttgta

SEQ ID NO: 3713 - DNA, 19 bp, Arabidopsis thaliana
ttgttgttgttgtagcaga

SEQ ID NO: 3714 - DNA, 22 bp, Arabidopsis thaliana
agcaagagctaaggaaaaggaa

SEQ ID NO: 3715 - DNA, 22 bp, Arabidopsis thaliana
agcaagagctaaggaaaaggaa

SEQ ID NO: 3716 - DNA, 19 bp, Arabidopsis thaliana
aagtgtttttgtttgcttg

SEQ ID NO: 3717 - DNA, 18 bp, Arabidopsis thaliana
ctgttgtgtcgatctaca

SEQ ID NO: 3718 - DNA, 23 bp, Arabidopsis thaliana
atttctgtgtgcttgtcattgaa

SEQ ID NO: 3719 - DNA, 19 bp, Arabidopsis thaliana
agaggttcaagtttgtgcg

SEQ ID NO: 3720 - DNA, 22 bp, Arabidopsis thaliana
atcttctttatcgttgttgaat

SEQ ID NO: 3721 - DNA, 18 bp, Arabidopsis thaliana
agtgaagaaccagtgaag

SEQ ID NO: 3722 - DNA, 19 bp, Arabidopsis thaliana
tatgcacacacactttcac

SEQ ID NO: 3723 - DNA, 20 bp, Arabidopsis thaliana
ttctctcaggttttgatatg

SEQ ID NO: 3724 - DNA, 23 bp, Arabidopsis thaliana
tagaggaagattgattttcttct

SEQ ID NO: 3725 - DNA, 20 bp, Arabidopsis thaliana
catgatcatcatcatgatca

SEQ ID NO: 3726 - DNA, 20 bp, Arabidopsis thaliana
tccaattcttttgatgtttc

SEQ ID NO: 3727 - DNA, 22 bp, Arabidopsis thaliana
ttgactctcttcttctacctca

SEQ ID NO: 3728 - DNA, 18 bp, Arabidopsis thaliana
tgagagagagagagcgcc

SEQ ID NO: 3729 - DNA, 19 bp, Arabidopsis thaliana
agagtgtgtgtgtgtttca

SEQ ID NO: 3730 - DNA, 19 bp, Arabidopsis thaliana
ttgttgagtgatgctgagg

SEQ ID NO: 3731 - DNA, 19 bp, Arabidopsis thaliana
atgtagtatgatgcagatc

SEQ ID NO: 3732 - DNA, 22 bp, Arabidopsis thaliana
tggtagtatgatgatgatgatt

SEQ ID NO: 3733 - DNA, 20 bp, Arabidopsis thaliana
ataggaggcaataacttgag

SEQ ID NO: 3734 - DNA, 23 bp, Arabidopsis thaliana
ctgtttgattccagcttttgtct

SEQ ID NO: 3735 - DNA, 18 bp, Arabidopsis thaliana
gagaagactctgagtcga

SEQ ID NO: 3736 - DNA, 23 bp, Arabidopsis thaliana
gaagatcaagatcaagatcaaga

SEQ ID NO: 3737 - DNA, 18 bp, Arabidopsis thaliana
gccttgtgatttagttct

SEQ ID NO: 3738 - DNA, 23 bp, Arabidopsis thaliana
agagatgttgttcttgatggagt

SEQ ID NO: 3739 - DNA, 18 bp, Arabidopsis thaliana
agagagagagagcttctg

SEQ ID NO: 3740 - DNA, 23 bp, Arabidopsis thaliana
aaacggtgtgtgtgtgtgttcag

SEQ ID NO: 3741 - DNA, 18 bp, Arabidopsis thaliana
ggagctcttcattcagca

SEQ ID NO: 3742 - DNA, 22 bp, Arabidopsis thaliana
aagaactctgtggatttctctg

SEQ ID NO: 3743 - DNA, 21 bp, Arabidopsis thaliana
tatgcatgggtgaagtgtgag

SEQ ID NO: 3744 - DNA, 21 bp, Arabidopsis thaliana
agagttgttcaagaagatggt

SEQ ID NO: 3745 - DNA, 18 bp, Arabidopsis thaliana
tggtttcttttgttgtgt

SEQ ID NO: 3746 - DNA, 23 bp, Arabidopsis thaliana
acctgttgttgttgatgaaggag

SEQ ID NO: 3747 - DNA, 19 bp, Arabidopsis thaliana
tgtgcttcttcttagagca

SEQ ID NO: 3748 - DNA, 23 bp, Arabidopsis thaliana
tacattggtgttggtgagggaga

SEQ ID NO: 3749 - DNA, 18 bp, Arabidopsis thaliana
agaaagaattgggaacag

SEQ ID NO: 3750 - DNA, 22 bp, Arabidopsis thaliana
tgagatcggaatcaatgatgtt

SEQ ID NO: 3751 - DNA, 18 bp, Arabidopsis thaliana
actgtggattttgatgtg

SEQ ID NO: 3752 - DNA, 20 bp, Arabidopsis thaliana
gtgaagtgaagtgtatctgt

SEQ ID NO: 3753 - DNA, 19 bp, Arabidopsis thaliana
agtctcttcttcttcatga

SEQ ID NO: 3754 - DNA, 21 bp, Arabidopsis thaliana
agctctgataccacatgttag

SEQ ID NO: 3755 - DNA, 22 bp, Arabidopsis thaliana
agctctgataccaattgtgaga

SEQ ID NO: 3756 - DNA, 20 bp, Arabidopsis thaliana
atatcaaagcttcaaggtag

SEQ ID NO: 3757 - DNA, 23 bp, Arabidopsis thaliana
agctctgataccaaatgatggaa

SEQ ID NO: 3758 - DNA, 20 bp, Arabidopsis thaliana
aaattaaagcttcaaggtag

SEQ ID NO: 3759 - DNA, 23 bp, Arabidopsis thaliana
atatgtatgtgcatgtatgtgtg

SEQ ID NO: 3760 - DNA, 20 bp, Arabidopsis thaliana
aagttatgtacgtatatgtg

SEQ ID NO: 3761 - DNA, 20 bp, Arabidopsis thaliana
tttagttttgttgctgctga

SEQ ID NO: 3762 - DNA, 19 bp, Arabidopsis thaliana
ctttttaaatgtagctgta

SEQ ID NO: 3763 - DNA, 22 bp, Arabidopsis thaliana
atgtggttgcaagttggaattg

SEQ ID NO: 3764 - DNA, 19 bp, Arabidopsis thaliana
tttatgatcttcaaggtct

SEQ ID NO: 3765 - DNA, 21 bp, Arabidopsis thaliana
tgtgtgtgtcttcatggtctt

SEQ ID NO: 3766 - DNA, 22 bp, Arabidopsis thaliana
aacagtagctttgatgttggtg

SEQ ID NO: 3767 - DNA, 20 bp, Arabidopsis thaliana
agtatgttgatgatggtggt

SEQ ID NO: 3768 - DNA, 19 bp, Arabidopsis thaliana
gtatcatattgcatgcata

SEQ ID NO: 3769 - DNA, 18 bp, Arabidopsis thaliana
tctgtctctctatctcta

SEQ ID NO: 3770 - DNA, 18 bp, Arabidopsis thaliana
gatctcatagtgaataga

SEQ ID NO: 3771 - DNA, 21 bp, Arabidopsis thaliana
tgtatctgcttctccttctct

SEQ ID NO: 3772 - DNA, 19 bp, Arabidopsis thaliana
tgatatctcaaggtgttct

SEQ ID NO: 3773 - DNA, 21 bp, Arabidopsis thaliana
agtttcctgatgatgcttcaa

SEQ ID NO: 3774 - DNA, 21 bp, Arabidopsis thaliana
agtttcctgatgatgcttcaa

SEQ ID NO: 3775 - DNA, 19 bp, Arabidopsis thaliana
tctctcttctcttgtcaac

SEQ ID NO: 3776 - DNA, 21 bp, Arabidopsis thaliana
aatgagtgtataaaagcttga

SEQ ID NO: 3777 - DNA, 23 bp, Arabidopsis thaliana
tatgtgtgtgtgtgtcagtgtat

SEQ ID NO: 3778 - DNA, 20 bp, Arabidopsis thaliana
aatttcatgatcatcctctt

SEQ ID NO: 3779 - DNA, 20 bp, Arabidopsis thaliana
tgtggttcttacttggatca

SEQ ID NO: 3780 - DNA, 23 bp, Arabidopsis thaliana
aataagatgatgatgatgatgat

SEQ ID NO: 3781 - DNA, 19 bp, Arabidopsis thaliana
tgtggtttcatttattgcc

SEQ ID NO: 3782 - DNA, 18 bp, Arabidopsis thaliana
gggcgagagagagtgact

SEQ ID NO: 3783 - DNA, 20 bp, Arabidopsis thaliana
gagcatcatcatcatcatcg

SEQ ID NO: 3784 - DNA, 23 bp, Arabidopsis thaliana
tgtttgttcttccttttacagga

SEQ ID NO: 3785 - DNA, 18 bp, Arabidopsis thaliana
gcacctgatcttcatcga

SEQ ID NO: 3786 - DNA, 18 bp, Arabidopsis thaliana
gtgatggtctctctgtct

SEQ ID NO: 3787 - DNA, 19 bp, Arabidopsis thaliana
acaaggtgttgatgatgat

SEQ ID NO: 3788 - DNA, 19 bp, Arabidopsis thaliana
atgtcaatggtaatgtact

SEQ ID NO: 3789 - DNA, 19 bp, Arabidopsis thaliana
tacaacgatcatgttgttg

SEQ ID NO: 3790 - DNA, 18 bp, Arabidopsis thaliana
ttgtgttgaggtggttct

SEQ ID NO: 3791 - DNA, 19 bp, Arabidopsis thaliana
tgaagaagaagatgaagaa

SEQ ID NO: 3792 - DNA, 20 bp, Arabidopsis thaliana
tgtgttgtgtgtatctagat

SEQ ID NO: 3793 - DNA, 20 bp, Arabidopsis thaliana
aactgtttagaaaatgtact

SEQ ID NO: 3794 - DNA, 18 bp, Arabidopsis thaliana
ctgtgttttagtttctct

SEQ ID NO: 3795 - DNA, 21 bp, Arabidopsis thaliana
ctgaagtgtttgggggaactc

SEQ ID NO: 3796 - DNA, 18 bp, Arabidopsis thaliana
tccatcttacttgagtca

SEQ ID NO: 3797 - DNA, 19 bp, Arabidopsis thaliana
ttttgcatgttcttggtca

SEQ ID NO: 3798 - DNA, 21 bp, Arabidopsis thaliana
ttgtcttcttcttctacgtct

SEQ ID NO: 3799 - DNA, 20 bp, Arabidopsis thaliana
gatgatgttgatgatcagcc

SEQ ID NO: 3800 - DNA, 20 bp, Arabidopsis thaliana
gttgaatgatgtgtttgtgt

SEQ ID NO: 3801 - DNA, 20 bp, Arabidopsis thaliana
taagactatctgcttaggtt

SEQ ID NO: 3802 - DNA, 18 bp, Arabidopsis thaliana
tcacatcatgctgaggtg

SEQ ID NO: 3803 - DNA, 23 bp, Arabidopsis thaliana
ttttcatgatgatgatgatggtg

SEQ ID NO: 3804 - DNA, 19 bp, Arabidopsis thaliana
tcaggttgttgttgttgct

SEQ ID NO: 3805 - DNA, 23 bp, Arabidopsis thaliana
tcttgttcttgttcttggaggtc

SEQ ID NO: 3806 - DNA, 23 bp, Arabidopsis thaliana
gagtgagtctctctgtcactgtc

SEQ ID NO: 3807 - DNA, 21 bp, Arabidopsis thaliana
tacgtgtgtgtgtttgtcttt

SEQ ID NO: 3808 - DNA, 21 bp, Arabidopsis thaliana
tactggtggtggtgctgctgc

SEQ ID NO: 3809 - DNA, 18 bp, Arabidopsis thaliana
ttgctattcttggatttg

SEQ ID NO: 3810 - DNA, 21 bp, Arabidopsis thaliana
tatatcacatttactttttga

SEQ ID NO: 3811 - DNA, 21 bp, Arabidopsis thaliana
gtgttgtgtgttgcactttct

SEQ ID NO: 3812 - DNA, 23 bp, Arabidopsis thaliana
aagttgttgttgttgctgctgca

SEQ ID NO: 3813 - DNA, 20 bp, Arabidopsis thaliana
agagagcatgcattgttgac

SEQ ID NO: 3814 - DNA, 23 bp, Arabidopsis thaliana
accttcttcatcttgctctgtag

SEQ ID NO: 3815 - DNA, 21 bp, Arabidopsis thaliana
atgtctagtgatgatgatgat

SEQ ID NO: 3816 - DNA, 19 bp, Arabidopsis thaliana
tggaagttgctacaatggt

SEQ ID NO: 3817 - DNA, 23 bp, Arabidopsis thaliana
tctgtgtgtctctgtctctgtgt

SEQ ID NO: 3818 - DNA, 20 bp, Arabidopsis thaliana
tgagaaatctttgacaccag

SEQ ID NO: 3819 - DNA, 20 bp, Arabidopsis thaliana
tagactttgtagatgtagaa

SEQ ID NO: 3820 - DNA, 20 bp, Arabidopsis thaliana
ctgtgtgtgagtgagtgtaa

SEQ ID NO: 3821 - DNA, 18 bp, Arabidopsis thaliana
atggtctcatgggtggtg

SEQ ID NO: 3822 - DNA, 20 bp, Arabidopsis thaliana
agcagcacaaaatgctttga

SEQ ID NO: 3823 - DNA, 21 bp, Arabidopsis thaliana
ttagagttttctggatactta

SEQ ID NO: 3824 - DNA, 21 bp, Arabidopsis thaliana
agagcttgattcatgtagaag

SEQ ID NO: 3825 - DNA, 19 bp, Arabidopsis thaliana
acggttagatttagtgtgt

SEQ ID NO: 3826 - DNA, 18 bp, Arabidopsis thaliana
ttgcttggttttgttatc

SEQ ID NO: 3827 - DNA, 21 bp, Arabidopsis thaliana
ggttcgtacgtacactgttca

SEQ ID NO: 3828 - DNA, 19 bp, Arabidopsis thaliana
gattacaaccaagtctgtg

SEQ ID NO: 3829 - DNA, 23 bp, Arabidopsis thaliana
tgtgtgtgtgagtaagtgaggga

SEQ ID NO: 3830 - DNA, 21 bp, Arabidopsis thaliana
gttgactgttgaggcatgtga

SEQ ID NO: 3831 - DNA, 23 bp, Arabidopsis thaliana
gtgctgtgtctgcttgttcatgt

SEQ ID NO: 3832 - DNA, 23 bp, Arabidopsis thaliana
agagacggaggttgggtgcgtcg

SEQ ID NO: 3833 - DNA, 21 bp, Arabidopsis thaliana
agtggaccagatggtttcatg

SEQ ID NO: 3834 - DNA, 18 bp, Arabidopsis thaliana
agaatgttgtggatgata

SEQ ID NO: 3835 - DNA, 21 bp, Arabidopsis thaliana
tagccaaggatgacttgcctg

SEQ ID NO: 3836 - DNA, 20 bp, Arabidopsis thaliana
taaattcaatatcattttca

SEQ ID NO: 3837 - DNA, 18 bp, Arabidopsis thaliana
atcgacttcttcttcttg

SEQ ID NO: 3838 - DNA, 23 bp, Arabidopsis thaliana
agagattgatggacaaactgtgt

SEQ ID NO: 3839 - DNA, 21 bp, Arabidopsis thaliana
atcagttttttgttcgtttca

SEQ ID NO: 3840 - DNA, 20 bp, Arabidopsis thaliana
aaacgaacaagaaactgatg

SEQ ID NO: 3841 - DNA, 19 bp, Arabidopsis thaliana
gatagagtccttgtttcta

SEQ ID NO: 3842 - DNA, 19 bp, Arabidopsis thaliana
aaagctcttacactatgac

SEQ ID NO: 3843 - DNA, 18 bp, Arabidopsis thaliana
aggtatgagaagatgatg

SEQ ID NO: 3844 - DNA, 18 bp, Arabidopsis thaliana
tggatcttgttgatggtg

SEQ ID NO: 3845 - DNA, 20 bp, Arabidopsis thaliana
agtcttcacattttgttgtt

SEQ ID NO: 3846 - DNA, 20 bp, Arabidopsis thaliana
ttctctatgatgatgttgca

SEQ ID NO: 3847 - DNA, 21 bp, Arabidopsis thaliana
accgtcttgtacgcattttct

SEQ ID NO: 3848 - DNA, 20 bp, Arabidopsis thaliana
aaaggcttggctgtgatgga

SEQ ID NO: 3849 - DNA, 19 bp, Arabidopsis thaliana
agcagcagcagcagcagca

SEQ ID NO: 3850 - DNA, 20 bp, Arabidopsis thaliana
atgaacttggtttttgagct

SEQ ID NO: 3851 - DNA, 19 bp, Arabidopsis thaliana
acacatcttataaaactga

SEQ ID NO: 3852 - DNA, 19 bp, Arabidopsis thaliana
taagagctacacattcggc

SEQ ID NO: 3853 - DNA, 21 bp, Arabidopsis thaliana
gttatgcatgttcatgttgat

SEQ ID NO: 3854 - DNA, 22 bp, Arabidopsis thaliana
tggcaatgatgaagatgctaga

SEQ ID NO: 3855 - DNA, 20 bp, Arabidopsis thaliana
tctgcttcttgatgttgctc

SEQ ID NO: 3856 - DNA, 22 bp, Arabidopsis thaliana
tacagtggtgatgatgttgatg

SEQ ID NO: 3857 - DNA, 21 bp, Arabidopsis thaliana
atgtatgtgtggttgtgtact

SEQ ID NO: 3858 - DNA, 22 bp, Arabidopsis thaliana
ttggtagttgaacaagtgaacc

SEQ ID NO: 3859 - DNA, 21 bp, Arabidopsis thaliana
atcatctttcttgctgctcat

SEQ ID NO: 3860 - DNA, 21 bp, Arabidopsis thaliana
actctctctctatttctgtct

SEQ ID NO: 3861 - DNA, 23 bp, Arabidopsis thaliana
tgtgactggttttgtgttgatgc

SEQ ID NO: 3862 - DNA, 22 bp, Arabidopsis thaliana
tgcaagaaagatgtgtgtctgt

SEQ ID NO: 3863 - DNA, 19 bp, Arabidopsis thaliana
tgagctttgtttttgttgt

SEQ ID NO: 3864 - DNA, 22 bp, Arabidopsis thaliana
tgtgtgtgtgtgtatgaagatg

SEQ ID NO: 3865 - DNA, 20 bp, Arabidopsis thaliana
gattcttgatgatgcaggag

SEQ ID NO: 3866 - DNA, 19 bp, Arabidopsis thaliana
ttgagtcttctgtgaggtc

SEQ ID NO: 3867 - DNA, 18 bp, Arabidopsis thaliana
caggagatgagattgtag

SEQ ID NO: 3868 - DNA, 19 bp, Arabidopsis thaliana
tctttctgtgaatgtgtgt

SEQ ID NO: 3869 - DNA, 23 bp, Arabidopsis thaliana
aagagattggctgagttcatggg

SEQ ID NO: 3870 - DNA, 19 bp, Arabidopsis thaliana
tgatattcttcatgatgga

SEQ ID NO: 3871 - DNA, 23 bp, Arabidopsis thaliana
ttcgtcttcttcatcttcttcgt

SEQ ID NO: 3872 - DNA, 20 bp, Arabidopsis thaliana
atgtactgacgtgcacgtgt

SEQ ID NO: 3873 - DNA, 18 bp, Arabidopsis thaliana
tgagatcttgctctgtga

SEQ ID NO: 3874 - DNA, 18 bp, Arabidopsis thaliana
gttgtttgatcctcgtct

SEQ ID NO: 3875 - DNA, 20 bp, Arabidopsis thaliana
agtgtgcttttgtaaacctg

SEQ ID NO: 3876 - DNA, 22 bp, Arabidopsis thaliana
aagctgaagatgctgatgtgag

SEQ ID NO: 3877 - DNA, 22 bp, Arabidopsis thaliana
tttttcctactccgcccatacc

SEQ ID NO: 3878 - DNA, 19 bp, Arabidopsis thaliana
tgtgtgcattggtgttcga

SEQ ID NO: 3879 - DNA, 23 bp, Arabidopsis thaliana
gttcatcatcatgatcatgatca

SEQ ID NO: 3880 - DNA, 23 bp, Arabidopsis thaliana
aactggtgatggtggtggtggac

SEQ ID NO: 3881 - DNA, 18 bp, Arabidopsis thaliana
gtgatggtggtggtggac

SEQ ID NO: 3882 - DNA, 19 bp, Arabidopsis thaliana
ttgtgagttttattggtga

SEQ ID NO: 3883 - DNA, 18 bp, Arabidopsis thaliana
cttcagctggtgttcttg

SEQ ID NO: 3884 - DNA, 23 bp, Arabidopsis thaliana
gattgagccgtgccaatatcacg

SEQ ID NO: 3885 - DNA, 22 bp, Arabidopsis thaliana
tatgaatggtgggcgtgatgtg

SEQ ID NO: 3886 - DNA, 23 bp, Arabidopsis thaliana
tcttcatcttcgtcatcatcatc

SEQ ID NO: 3887 - DNA, 21 bp, Arabidopsis thaliana
atcttcctcttctattgatga

SEQ ID NO: 3888 - DNA, 18 bp, Arabidopsis thaliana
taagtgcttccattctct

SEQ ID NO: 3889 - DNA, 20 bp, Arabidopsis thaliana
atgtgtgtatgtttgtagat

SEQ ID NO: 3890 - DNA, 21 bp, Arabidopsis thaliana
catgtgattgattcttcttgt

SEQ ID NO: 3891 - DNA, 21 bp, Arabidopsis thaliana
tgtgattctgattcatgtatc

SEQ ID NO: 3892 - DNA, 21 bp, Arabidopsis thaliana
gttgagtgatgttggagagag

SEQ ID NO: 3893 - DNA, 19 bp, Arabidopsis thaliana
actctcctggacatcgggt

SEQ ID NO: 3894 - DNA, 23 bp, Arabidopsis thaliana
tttggattgaagggagctctaca

SEQ ID NO: 3895 - DNA, 20 bp, Arabidopsis thaliana
aaatcgtcgtcgtctgctca

SEQ ID NO: 3896 - DNA, 20 bp, Arabidopsis thaliana
aagtgatgatgatgatttgt

SEQ ID NO: 3897 - DNA, 20 bp, Arabidopsis thaliana
tgtgcctgtgagtttgtctt

SEQ ID NO: 3898 - DNA, 23 bp, Arabidopsis thaliana
tgctgctgtagctgcagctgctg

SEQ ID NO: 3899 - DNA, 19 bp, Arabidopsis thaliana
tacgttgatcttcatgcag

SEQ ID NO: 3900 - DNA, 18 bp, Arabidopsis thaliana
tttgtgtgtgtttatcag

SEQ ID NO: 3901 - DNA, 20 bp, Arabidopsis thaliana
atatgtatgtgcatgtatat

SEQ ID NO: 3902 - DNA, 23 bp, Arabidopsis thaliana
ctctctctctctctctcaatgtg

SEQ ID NO: 3903 - DNA, 18 bp, Arabidopsis thaliana
cacctctcgatgctgtca

SEQ ID NO: 3904 - DNA, 23 bp, Arabidopsis thaliana
tgattgatcatgtgtgtgtgtgt

SEQ ID NO: 3905 - DNA, 22 bp, Arabidopsis thaliana
atggttgatgatgatgttgcag

SEQ ID NO: 3906 - DNA, 22 bp, Arabidopsis thaliana
actctgtctctatctctatatc

SEQ ID NO: 3907 - DNA, 19 bp, Arabidopsis thaliana
tgagatgggtgtgtgtgag

SEQ ID NO: 3908 - DNA, 19 bp, Arabidopsis thaliana
tcgaatattgttgatgatg

SEQ ID NO: 3909 - DNA, 21 bp, Arabidopsis thaliana
ggtgacttgtgaatttgttgt

SEQ ID NO: 3910 - DNA, 19 bp, Arabidopsis thaliana
aaaaaccattttgttttgg

SEQ ID NO: 3911 - DNA, 18 bp, Arabidopsis thaliana
atcagttcaactttgaga

SEQ ID NO: 3912 - DNA, 22 bp, Arabidopsis thaliana
aaatcttcttcttcttcgtcca

SEQ ID NO: 3913 - DNA, 23 bp, Arabidopsis thaliana
ctgtgtgtcagtgtgtctgtgtg

SEQ ID NO: 3914 - DNA, 23 bp, Arabidopsis thaliana
tgttcatcttcttcaacttcatc

SEQ ID NO: 3915 - DNA, 21 bp, Arabidopsis thaliana
actgtctgctggtgttgggga

SEQ ID NO: 3916 - DNA, 22 bp, Arabidopsis thaliana
tactgttgcacctttccatatt

SEQ ID NO: 3917 - DNA, 19 bp, Arabidopsis thaliana
actacatagaaaagtgttg

SEQ ID NO: 3918 - DNA, 21 bp, Arabidopsis thaliana
aatgctgacagagatagtaga

SEQ ID NO: 3919 - DNA, 23 bp, Arabidopsis thaliana
ctttgtgtgtgtgtttgaagata

SEQ ID NO: 3920 - DNA, 18 bp, Arabidopsis thaliana
aagtgcttgcaggtagat

SEQ ID NO: 3921 - DNA, 22 bp, Arabidopsis thaliana
cttttgatgatgttgctggagt

SEQ ID NO: 3922 - DNA, 22 bp, Arabidopsis thaliana
aattgtcatgtgttggtatctt

SEQ ID NO: 3923 - DNA, 18 bp, Arabidopsis thaliana
tgagactgcttcttcttc

SEQ ID NO: 3924 - DNA, 19 bp, Arabidopsis thaliana
atgatgctgatgatgtggt

SEQ ID NO: 3925 - DNA, 21 bp, Arabidopsis thaliana
tggtttcttgtgaagtgtgtc

SEQ ID NO: 3926 - DNA, 23 bp, Arabidopsis thaliana
ctttctcttcaagcacatctcgg

SEQ ID NO: 3927 - DNA, 21 bp, Arabidopsis thaliana
tctacttggagttgtgcttga

SEQ ID NO: 3928 - DNA, 21 bp, Arabidopsis thaliana
tctctctcctttcttcgttga

SEQ ID NO: 3929 - DNA, 21 bp, Arabidopsis thaliana
tgaaatagatgtttgatgatt

SEQ ID NO: 3930 - DNA, 18 bp, Arabidopsis thaliana
tgtttctccttgtgaaag

SEQ ID NO: 3931 - DNA, 18 bp, Arabidopsis thaliana
ttgactgaagattgcatt

SEQ ID NO: 3932 - DNA, 23 bp, Arabidopsis thaliana
tctctctttctctctgtctgagt

SEQ ID NO: 3933 - DNA, 19 bp, Arabidopsis thaliana
atctagttgcatgttttga

SEQ ID NO: 3934 - DNA, 21 bp, Arabidopsis thaliana
ttcaggtgctgattgaggcag

SEQ ID NO: 3935 - DNA, 20 bp, Arabidopsis thaliana
atttgattgttgttggcatc

SEQ ID NO: 3936 - DNA, 19 bp, Arabidopsis thaliana
gaggaatggtgttattgtg

SEQ ID NO: 3937 - DNA, 22 bp, Arabidopsis thaliana
tgaatcttcttcttcttcgagt

SEQ ID NO: 3938 - DNA, 19 bp, Arabidopsis thaliana
tggatgtagatgaagctca

SEQ ID NO: 3939 - DNA, 23 bp, Arabidopsis thaliana
tgcagccgctggtgctgctgctg

SEQ ID NO: 3940 - DNA, 19 bp, Arabidopsis thaliana
tatgatcaaaatcttcgac

SEQ ID NO: 3941 - DNA, 21 bp, Arabidopsis thaliana
aacttgttgttgtttgaggtt

SEQ ID NO: 3942 - DNA, 20 bp, Arabidopsis thaliana
tagagagtagagagagtaga

SEQ ID NO: 3943 - DNA, 23 bp, Arabidopsis thaliana
agattcctgatgatgatgaagat

SEQ ID NO: 3944 - DNA, 21 bp, Arabidopsis thaliana
tcatcatcatcttcattatca

SEQ ID NO: 3945 - DNA, 23 bp, Arabidopsis thaliana
ctttttcttcttcatgctcgtgt

SEQ ID NO: 3946 - DNA, 19 bp, Arabidopsis thaliana
tacagattggcgttagagg

SEQ ID NO: 3947 - DNA, 20 bp, Arabidopsis thaliana
ttagtgttgttgttgctgaa

SEQ ID NO: 3948 - DNA, 23 bp, Arabidopsis thaliana
atgatgatgatgatgatgatgat

SEQ ID NO: 3949 - DNA, 21 bp, Arabidopsis thaliana
tcattttcatcttcatcatca

SEQ ID NO: 3950 - DNA, 18 bp, Arabidopsis thaliana
tgaagccttttgttgttg

SEQ ID NO: 3951 - DNA, 22 bp, Arabidopsis thaliana
tatgtctgtgtacttgctcttt

SEQ ID NO: 3952 - DNA, 21 bp, Arabidopsis thaliana
tgtgaatactgtgagcagtgg

SEQ ID NO: 3953 - DNA, 19 bp, Arabidopsis thaliana
taagtctttttcttttgtt

SEQ ID NO: 3954 - DNA, 19 bp, Arabidopsis thaliana
tgtcaagtttactatgtga

SEQ ID NO: 3955 - DNA, 20 bp, Arabidopsis thaliana
gcctggtgttcttgttggtg

SEQ ID NO: 3956 - DNA, 19 bp, Arabidopsis thaliana
tttttgttgttgttgtcat

SEQ ID NO: 3957 - DNA, 18 bp, Arabidopsis thaliana
gaagagcaaagagagcag

SEQ ID NO: 3958 - DNA, 23 bp, Arabidopsis thaliana
tgctgctggagttgctgctgctg

SEQ ID NO: 3959 - DNA, 20 bp, Arabidopsis thaliana
ttgtcattggagattttgct

SEQ ID NO: 3960 - DNA, 18 bp, Arabidopsis thaliana
ctgctgtgtttctgaatt

SEQ ID NO: 3961 - DNA, 21 bp, Arabidopsis thaliana
tccaggagcacaagtatgctg

SEQ ID NO: 3962 - DNA, 18 bp, Arabidopsis thaliana
gtcagtggtaccgtctcc

SEQ ID NO: 3963 - DNA, 18 bp, Arabidopsis thaliana
ctgtctctcaatatctct

SEQ ID NO: 3964 - DNA, 22 bp, Arabidopsis thaliana
gcactggatgctttctcggttg

SEQ ID NO: 3965 - DNA, 23 bp, Arabidopsis thaliana
tgtagactgatgatgatgcacct

SEQ ID NO: 3966 - DNA, 21 bp, Arabidopsis thaliana
tttctgtcaggttaagatagg

SEQ ID NO: 3967 - DNA, 18 bp, Arabidopsis thaliana
agttttgtgatgtaggag

SEQ ID NO: 3968 - DNA, 18 bp, Arabidopsis thaliana
tgaagctgctgcagttgc

SEQ ID NO: 3969 - DNA, 20 bp, Arabidopsis thaliana
gctggtgttgagattcatcc

SEQ ID NO: 3970 - DNA, 18 bp, Arabidopsis thaliana
catcgtcttcttcctcga

SEQ ID NO: 3971 - DNA, 23 bp, Arabidopsis thaliana
agagttgtgtgtggatgtgcaag

SEQ ID NO: 3972 - DNA, 19 bp, Arabidopsis thaliana
tagtccttctctgttcttg

SEQ ID NO: 3973 - DNA, 20 bp, Arabidopsis thaliana
atctctcgggctgtgttgtg

SEQ ID NO: 3974 - DNA, 23 bp, Arabidopsis thaliana
tcgagatggttctgatggtgatt

SEQ ID NO: 3975 - DNA, 22 bp, Arabidopsis thaliana
aatcaggtacttcttctgagag

SEQ ID NO: 3976 - DNA, 23 bp, Arabidopsis thaliana
atctgtagtgatgttgaactgag

SEQ ID NO: 3977 - DNA, 21 bp, Arabidopsis thaliana
ctgaagtgtttgggggaactc

SEQ ID NO: 3978 - DNA, 21 bp, Arabidopsis thaliana
ctgaagtgtttgggggaactc

SEQ ID NO: 3979 - DNA, 22 bp, Arabidopsis thaliana
tatgtgcgtgtgtatatgcatg

SEQ ID NO: 3980 - DNA, 18 bp, Arabidopsis thaliana
tggaagaaggcaaagctg

SEQ ID NO: 3981 - DNA, 23 bp, Arabidopsis thaliana
tatgtttttgattcttgatccat

SEQ ID NO: 3982 - DNA, 19 bp, Arabidopsis thaliana
tccataaagttggctttct

SEQ ID NO: 3983 - DNA, 18 bp, Arabidopsis thaliana
tcatgattttgaaactag

SEQ ID NO: 3984 - DNA, 21 bp, Arabidopsis thaliana
tcagactgctgggatctgtgt

SEQ ID NO: 3985 - DNA, 20 bp, Arabidopsis thaliana
ctgtgtttgccttagtcaga

SEQ ID NO: 3986 - DNA, 20 bp, Arabidopsis thaliana
ttattggcctatcggattgg

SEQ ID NO: 3987 - DNA, 23 bp, Arabidopsis thaliana
ggtccctgggacaccatgagaca

SEQ ID NO: 3988 - DNA, 20 bp, Arabidopsis thaliana
cacagagagagcgagagagt

SEQ ID NO: 3989 - DNA, 19 bp, Arabidopsis thaliana
tgatgaagaagaagaagaa

SEQ ID NO: 3990 - DNA, 20 bp, Arabidopsis thaliana
aatctcagctttctgttttg

SEQ ID NO: 3991 - DNA, 20 bp, Arabidopsis thaliana
ttgattgttcttcatttgca

SEQ ID NO: 3992 - DNA, 21 bp, Arabidopsis thaliana
taccaacctttcatcgttccc

SEQ ID NO: 3993 - DNA, 22 bp, Arabidopsis thaliana
agaagaagtagaagaagaagct

SEQ ID NO: 3994 - DNA, 19 bp, Arabidopsis thaliana
tatgtgttcttcttcctct

SEQ ID NO: 3995 - DNA, 20 bp, Arabidopsis thaliana
catcttcatcatcatcgtca

SEQ ID NO: 3996 - DNA, 22 bp, Arabidopsis thaliana
attcatcttcttgttgtagatc

SEQ ID NO: 3997 - DNA, 23 bp, Arabidopsis thaliana
tgtcttgtgtgtgtatgtgtgtg

SEQ ID NO: 3998 - DNA, 23 bp, Arabidopsis thaliana
ttgacagaagatagagagcacag

SEQ ID NO: 3999 - DNA, 21 bp, Arabidopsis thaliana
cagtctgctcttcttctggat

SEQ ID NO: 4000 - DNA, 21 bp, Arabidopsis thaliana
ttgaagaggacctggaactcg

SEQ ID NO: 4001 - DNA, 19 bp, Arabidopsis thaliana
tctcaggtatttttcatca

SEQ ID NO: 4002 - DNA, 18 bp, Arabidopsis thaliana
tgatgatcatggtttgtt

SEQ ID NO: 4003 - DNA, 19 bp, Arabidopsis thaliana
tcactttggtatactgtgt

SEQ ID NO: 4004 - DNA, 19 bp, Arabidopsis thaliana
agaggaagagatttgtctt

SEQ ID NO: 4005 - DNA, 21 bp, Arabidopsis thaliana
acgatttgtagttgatgtttc

SEQ ID NO: 4006 - DNA, 19 bp, Arabidopsis thaliana
ataagtgtgattatgatgt

SEQ ID NO: 4007 - DNA, 19 bp, Arabidopsis thaliana
atagagagagagtgagtga

SEQ ID NO: 4008 - DNA, 20 bp, Arabidopsis thaliana
ttgtgtctatgtatgtggaa

SEQ ID NO: 4009 - DNA, 19 bp, Arabidopsis thaliana
tctcatcttgtttttgttg

SEQ ID NO: 4010 - DNA, 23 bp, Arabidopsis thaliana
tcagagcaatgagaatgtggaca

SEQ ID NO: 4011 - DNA, 19 bp, Arabidopsis thaliana
gagatgggattggtggaag

SEQ ID NO: 4012 - DNA, 21 bp, Arabidopsis thaliana
gacggtggtgagatggttctg

SEQ ID NO: 4013 - DNA, 20 bp, Arabidopsis thaliana
atgtacatgtgtatgtccat

SEQ ID NO: 4014 - DNA, 21 bp, Arabidopsis thaliana
tggatggttttctagctgata

SEQ ID NO: 4015 - DNA, 22 bp, Arabidopsis thaliana
actctctcgtcttgttccggag

SEQ ID NO: 4016 - DNA, 22 bp, Arabidopsis thaliana
gaacagagttgttgtagttgtt

SEQ ID NO: 4017 - DNA, 18 bp, Arabidopsis thaliana
tgattccatttcaagctg

SEQ ID NO: 4018 - DNA, 23 bp, Arabidopsis thaliana
agtgtgtgtgagagtgtatgttc

SEQ ID NO: 4019 - DNA, 20 bp, Arabidopsis thaliana
tttgtgttgatgatcattgt

SEQ ID NO: 4020 - DNA, 18 bp, Arabidopsis thaliana
taggttgtgcaaagttct

SEQ ID NO: 4021 - DNA, 18 bp, Arabidopsis thaliana
tgtgtgtatgtgtgtatg

SEQ ID NO: 4022 - DNA, 23 bp, Arabidopsis thaliana
tgtgtaaacatgtggatgtgtgt

SEQ ID NO: 4023 - DNA, 23 bp, Arabidopsis thaliana
tgattgagccgtgccaatatcac

SEQ ID NO: 4024 - DNA, 19 bp, Arabidopsis thaliana
tcctgatgatgctggagat

SEQ ID NO: 4025 - DNA, 20 bp, Arabidopsis thaliana
ttgtggtggaatgttgaagt

SEQ ID NO: 4026 - DNA, 20 bp, Arabidopsis thaliana
cagagatttcacaacctgtt

SEQ ID NO: 4027 - DNA, 23 bp, Arabidopsis thaliana
gaagatcatcatcatcatcctct

SEQ ID NO: 4028 - DNA, 23 bp, Arabidopsis thaliana
taaattgaagtgcttgaatgtaa

SEQ ID NO: 4029 - DNA, 23 bp, Arabidopsis thaliana
ttgtgttgttgttcctgattttg

SEQ ID NO: 4030 - DNA, 23 bp, Arabidopsis thaliana
agcagtgacagctttggttgctg

SEQ ID NO: 4031 - DNA, 21 bp, Arabidopsis thaliana
attgctttgttgaagcagtat

SEQ ID NO: 4032 - DNA, 23 bp, Arabidopsis thaliana
acttggagagtgtcaaagttgtt

SEQ ID NO: 4033 - DNA, 18 bp, Arabidopsis thaliana
agaagtgtacctggtttg

SEQ ID NO: 4034 - DNA, 20 bp, Arabidopsis thaliana
atgattttcgttgttgttgt

SEQ ID NO: 4035 - DNA, 20 bp, Arabidopsis thaliana
aatgtgtgagttgatgacaa

SEQ ID NO: 4036 - DNA, 23 bp, Arabidopsis thaliana
agcagagatgtttgagaggagct

SEQ ID NO: 4037 - DNA, 18 bp, Arabidopsis thaliana
atcttcttcagcttcgag

SEQ ID NO: 4038 - DNA, 19 bp, Arabidopsis thaliana
ttgtgtttgttgtaggact

SEQ ID NO: 4039 - DNA, 23 bp, Arabidopsis thaliana
tctgtctgggtctctctgtcttt

SEQ ID NO: 4040 - DNA, 19 bp, Arabidopsis thaliana
atgtgtgtgtttgtgactg

SEQ ID NO: 4041 - DNA, 21 bp, Arabidopsis thaliana
tcttcttcttctgcatctgct

SEQ ID NO: 4042 - DNA, 19 bp, Arabidopsis thaliana
tctctctctatatctctac

SEQ ID NO: 4043 - DNA, 19 bp, Arabidopsis thaliana
tctctctctgtcttctagg

SEQ ID NO: 4044 - DNA, 19 bp, Arabidopsis thaliana
gacagtgtgtgtttttggg

SEQ ID NO: 4045 - DNA, 20 bp, Arabidopsis thaliana
tatctctgtcttcatcttca

SEQ ID NO: 4046 - DNA, 19 bp, Arabidopsis thaliana
gacagtgtgtgtttttggg

SEQ ID NO: 4047 - DNA, 20 bp, Arabidopsis thaliana
tatctctgtcttcatcttca

SEQ ID NO: 4048 - DNA, 20 bp, Arabidopsis thaliana
tgtgtgcattggtgcttgtg

SEQ ID NO: 4049 - DNA, 19 bp, Arabidopsis thaliana
ttcagagagggagagatga

SEQ ID NO: 4050 - DNA, 18 bp, Arabidopsis thaliana
acctccgagtgaaagtgc

SEQ ID NO: 4051 - DNA, 20 bp, Arabidopsis thaliana
ctgctgatggtgcaggtgag

SEQ ID NO: 4052 - DNA, 23 bp, Arabidopsis thaliana
ttgagagagtgagtgagtgtgag

SEQ ID NO: 4053 - DNA, 21 bp, Arabidopsis thaliana
tcatcttcttcttcatcgaga

SEQ ID NO: 4054 - DNA, 21 bp, Arabidopsis thaliana
tcttgctcttcttcttcgtgc

SEQ ID NO: 4055 - DNA, 19 bp, Arabidopsis thaliana
tcattgcttttcttggact

SEQ ID NO: 4056 - DNA, 21 bp, Arabidopsis thaliana
ctgtgcaatgtttcagctgta

SEQ ID NO: 4057 - DNA, 23 bp, Arabidopsis thaliana
ttcgatgctgtgagtgtttcttc

SEQ ID NO: 4058 - DNA, 21 bp, Arabidopsis thaliana
tttttcatcatcttcgtcttc

SEQ ID NO: 4059 - DNA, 21 bp, Arabidopsis thaliana
gaagaagatggtggtggtatc

SEQ ID NO: 4060 - DNA, 20 bp, Arabidopsis thaliana
ttgccactgtttttgttgtt

SEQ ID NO: 4061 - DNA, 23 bp, Arabidopsis thaliana
tggtgatgatgatgatgatgatg

SEQ ID NO: 4062 - DNA, 21 bp, Arabidopsis thaliana
tgtgcttgttgcaactgtgtg

SEQ ID NO: 4063 - DNA, 19 bp, Arabidopsis thaliana
ttctgtgtctgcatgtctt

SEQ ID NO: 4064 - DNA, 19 bp, Arabidopsis thaliana
tgttgttgaagatcttgga

SEQ ID NO: 4065 - DNA, 18 bp, Arabidopsis thaliana
cagctggtgttgctgctg

SEQ ID NO: 4066 - DNA, 23 bp, Arabidopsis thaliana
gagcatgatgatgatgaagatga

SEQ ID NO: 4067 - DNA, 19 bp, Arabidopsis thaliana
agagagcatgcattgttga

SEQ ID NO: 4068 - DNA, 23 bp, Arabidopsis thaliana
tgtgtgactgtgtgcatgtatct

SEQ ID NO: 4069 - DNA, 20 bp, Arabidopsis thaliana
agagagagagagagagagag

SEQ ID NO: 4070 - DNA, 18 bp, Arabidopsis thaliana
agtgattgtgaggtggtg

SEQ ID NO: 4071 - DNA, 23 bp, Arabidopsis thaliana
ttagaagttttatgttgaagaag

SEQ ID NO: 4072 - DNA, 23 bp, Arabidopsis thaliana
agtgtgatgataatgattgttgt

SEQ ID NO: 4073 - DNA, 18 bp, Arabidopsis thaliana
ctctctctcactttctct

SEQ ID NO: 4074 - DNA, 19 bp, Arabidopsis thaliana
tcaacattcttgatgttgt

SEQ ID NO: 4075 - DNA, 19 bp, Arabidopsis thaliana
tttggttatcttgggaaaa

SEQ ID NO: 4076 - DNA, 18 bp, Arabidopsis thaliana
gtgctcactctcttctgt

SEQ ID NO: 4077 - DNA, 21 bp, Arabidopsis thaliana
tccaataggtcgagcatgtgc

SEQ ID NO: 4078 - DNA, 21 bp, Arabidopsis thaliana
atatgctggatctacttgaag

SEQ ID NO: 4079 - DNA, 20 bp, Arabidopsis thaliana
aagagagaactatgagatga

SEQ ID NO: 4080 - DNA, 18 bp, Arabidopsis thaliana
agtgcttgctgttgctgt

SEQ ID NO: 4081 - DNA, 20 bp, Arabidopsis thaliana
tccagcaggtggagcagcac

SEQ ID NO: 4082 - DNA, 20 bp, Arabidopsis thaliana
accaccaccaccaccagcag

SEQ ID NO: 4083 - DNA, 23 bp, Arabidopsis thaliana
ttctcaagaaggtgcatgaacaa

SEQ ID NO: 4084 - DNA, 19 bp, Arabidopsis thaliana
tttgtgattgattcttgaa

SEQ ID NO: 4085 - DNA, 20 bp, Arabidopsis thaliana
tgatgacaggtactcgtatg

SEQ ID NO: 4086 - DNA, 23 bp, Arabidopsis thaliana
gatgctgttgtgaatgtgatctt

SEQ ID NO: 4087 - DNA, 22 bp, Arabidopsis thaliana
atgtcactcatttggtttctgt

SEQ ID NO: 4088 - DNA, 18 bp, Arabidopsis thaliana
tagctagattttcctttg

SEQ ID NO: 4089 - DNA, 19 bp, Arabidopsis thaliana
acatcgtcatcttcgtcgt

SEQ ID NO: 4090 - DNA, 23 bp, Arabidopsis thaliana
atcctcatcttcatcatcgacat

SEQ ID NO: 4091 - DNA, 19 bp, Arabidopsis thaliana
atccacccgggcaaggaaa

SEQ ID NO: 4092 - DNA, 19 bp, Arabidopsis thaliana
ttgtgtcagaatttgaacc

SEQ ID NO: 4093 - DNA, 23 bp, Arabidopsis thaliana
acgcagctggtggtgatgcttct

SEQ ID NO: 4094 - DNA, 19 bp, Arabidopsis thaliana
aggcatgctgctgctgcag

SEQ ID NO: 4095 - DNA, 20 bp, Arabidopsis thaliana
tttggtatatgaggaagttg

SEQ ID NO: 4096 - DNA, 19 bp, Arabidopsis thaliana
atgagtgtgtgagtgtcca

SEQ ID NO: 4097 - DNA, 18 bp, Arabidopsis thaliana
tagattgtacttgaattg

SEQ ID NO: 4098 - DNA, 22 bp, Arabidopsis thaliana
agcaaaacataaggaaatgtat

SEQ ID NO: 4099 - DNA, 18 bp, Arabidopsis thaliana
actgcattcagaggaggt

SEQ ID NO: 4100 - DNA, 18 bp, Arabidopsis thaliana
ttgacaatgatgaatcat

SEQ ID NO: 4101 - DNA, 23 bp, Arabidopsis thaliana
ttgttctctgatgatatgttgat

SEQ ID NO: 4102 - DNA, 19 bp, Arabidopsis thaliana
tggccgtggatagtagcac

SEQ ID NO: 4103 - DNA, 23 bp, Arabidopsis thaliana
agctcttcatcttcatcttcatc

SEQ ID NO: 4104 - DNA, 20 bp, Arabidopsis thaliana
acagtccttttcttttgtac

SEQ ID NO: 4105 - DNA, 20 bp, Arabidopsis thaliana
gagaagagtctctgctgtgc

SEQ ID NO: 4106 - DNA, 21 bp, Arabidopsis thaliana
atcccattgttgttgttgttt

SEQ ID NO: 4107 - DNA, 22 bp, Arabidopsis thaliana
agaagatgaagaagattcttca

SEQ ID NO: 4108 - DNA, 18 bp, Arabidopsis thaliana
agagagagggagttgcag

SEQ ID NO: 4109 - DNA, 19 bp, Arabidopsis thaliana
tactaagtttactagctct

SEQ ID NO: 4110 - DNA, 20 bp, Arabidopsis thaliana
tgttgttgttgttgatcgtg

SEQ ID NO: 4111 - DNA, 19 bp, Arabidopsis thaliana
tgttgttgttgttctcttg

SEQ ID NO: 4112 - DNA, 19 bp, Arabidopsis thaliana
gatggaggagaagtggaag

SEQ ID NO: 4113 - DNA, 18 bp, Arabidopsis thaliana
agcttcttcttcctcctc

SEQ ID NO: 4114 - DNA, 20 bp, Arabidopsis thaliana
tcattgagtgcagcattgat

SEQ ID NO: 4115 - DNA, 18 bp, Arabidopsis thaliana
tttggtggtgatgatgag

SEQ ID NO: 4116 - DNA, 19 bp, Arabidopsis thaliana
gtgcttctgcttctgagtg

SEQ ID NO: 4117 - DNA, 19 bp, Arabidopsis thaliana
ttctcaacaagctggtgca

SEQ ID NO: 4118 - DNA, 19 bp, Arabidopsis thaliana
ccacaacagtgtcagacac

SEQ ID NO: 4119 - DNA, 20 bp, Arabidopsis thaliana
tttgattgatgatgatgacg

SEQ ID NO: 4120 - DNA, 23 bp, Arabidopsis thaliana
tcggtctagatgatgatgatgat

SEQ ID NO: 4121 - DNA, 18 bp, Arabidopsis thaliana
ttctcttcttcttcttga

SEQ ID NO: 4122 - DNA, 23 bp, Arabidopsis thaliana
agttcaggttccttatgttggag

SEQ ID NO: 4123 - DNA, 20 bp, Arabidopsis thaliana
actgctggagctgcggctgg

SEQ ID NO: 4124 - DNA, 22 bp, Arabidopsis thaliana
ttggttgtgtgtacatgatgtt

SEQ ID NO: 4125 - DNA, 20 bp, Arabidopsis thaliana
tttgggatgcattgctttca

SEQ ID NO: 4126 - DNA, 19 bp, Arabidopsis thaliana
ttttcttgtacatgattga

SEQ ID NO: 4127 - DNA, 20 bp, Arabidopsis thaliana
tttgctgcaattgttggatt

SEQ ID NO: 4128 - DNA, 20 bp, Arabidopsis thaliana
tctttggttatatagatgtt

SEQ ID NO: 4129 - DNA, 21 bp, Arabidopsis thaliana
tacaatgtgatgtgtgtgaga

SEQ ID NO: 4130 - DNA, 19 bp, Arabidopsis thaliana
aagttcttgaaacttcttc

SEQ ID NO: 4131 - DNA, 23 bp, Arabidopsis thaliana
tgtctgtgcttgttgattgttgt

SEQ ID NO: 4132 - DNA, 19 bp, Arabidopsis thaliana
actgtgtttttcggttgat

SEQ ID NO: 4133 - DNA, 18 bp, Arabidopsis thaliana
ttctaagtgatattgttg

SEQ ID NO: 4134 - DNA, 18 bp, Arabidopsis thaliana
tgaaaatggtgacactct

SEQ ID NO: 4135 - DNA, 19 bp, Arabidopsis thaliana
aagtgtgtgtgtttgtgaa

SEQ ID NO: 4136 - DNA, 20 bp, Arabidopsis thaliana
agttttgattggtgtttttc

SEQ ID NO: 4137 - DNA, 21 bp, Arabidopsis thaliana
tttaaatcatatacttttggt

SEQ ID NO: 4138 - DNA, 20 bp, Arabidopsis thaliana
aagcagaagatgaagaagaa

SEQ ID NO: 4139 - DNA, 19 bp, Arabidopsis thaliana
tggttgtgacatgttgtag

SEQ ID NO: 4140 - DNA, 20 bp, Arabidopsis thaliana
acggtggcacagatgcagca

SEQ ID NO: 4141 - DNA, 20 bp, Arabidopsis thaliana
ggtgttcattgtcatgcagt

SEQ ID NO: 4142 - DNA, 20 bp, Arabidopsis thaliana
atgagttgctgtttcttgtt

SEQ ID NO: 4143 - DNA, 20 bp, Arabidopsis thaliana
tttgcttgctctgtgtctct

SEQ ID NO: 4144 - DNA, 23 bp, Arabidopsis thaliana
tgatgatgatgatgatgatgatg

SEQ ID NO: 4145 - DNA, 23 bp, Arabidopsis thaliana
aaagttcttgttgttgttgaagt

SEQ ID NO: 4146 - DNA, 18 bp, Arabidopsis thaliana
agctttgatgctggtcat

SEQ ID NO: 4147 - DNA, 21 bp, Arabidopsis thaliana
tgccaaaggagatttgcctcg

SEQ ID NO: 4148 - DNA, 19 bp, Arabidopsis thaliana
cataaatgtttgtggtgag

SEQ ID NO: 4149 - DNA, 21 bp, Arabidopsis thaliana
tgccaaaggagatttgcccgg

SEQ ID NO: 4150 - DNA, 20 bp, Arabidopsis thaliana
atgtgtttgttcatgttctt

SEQ ID NO: 4151 - DNA, 21 bp, Arabidopsis thaliana
aaacggtgaccattagtgaca

SEQ ID NO: 4152 - DNA, 23 bp, Arabidopsis thaliana
ttgatgttgcattgttgagagtt

SEQ ID NO: 4153 - DNA, 22 bp, Arabidopsis thaliana
ctcccagctgttctttttgttc

SEQ ID NO: 4154 - DNA, 20 bp, Arabidopsis thaliana
cttcatcatcatcatcttca

SEQ ID NO: 4155 - DNA, 18 bp, Arabidopsis thaliana
gaccagagagagaagagc

SEQ ID NO: 4156 - DNA, 22 bp, Arabidopsis thaliana
tgtgtgtgcatagctttatctg

SEQ ID NO: 4157 - DNA, 18 bp, Arabidopsis thaliana
tcgtgtcttcttgctcgg

SEQ ID NO: 4158 - DNA, 20 bp, Arabidopsis thaliana
ttgagacgacaaaaaatctt

SEQ ID NO: 4159 - DNA, 19 bp, Arabidopsis thaliana
tgtgatgaatgacttgaca

SEQ ID NO: 4160 - DNA, 23 bp, Arabidopsis thaliana
tctttcttgttcttcatgtgttc

SEQ ID NO: 4161 - DNA, 20 bp, Arabidopsis thaliana
aagtttgtgtagatctagat

SEQ ID NO: 4162 - DNA, 23 bp, Arabidopsis thaliana
tgtctgatgttgttgctgctgct

SEQ ID NO: 4163 - DNA, 19 bp, Arabidopsis thaliana
aagctgcacttgatgtttt

SEQ ID NO: 4164 - DNA, 19 bp, Arabidopsis thaliana
agtgtttgtgcttgagtct

SEQ ID NO: 4165 - DNA, 23 bp, Arabidopsis thaliana
actgtgagtgtgtctgtgcgtga

SEQ ID NO: 4166 - DNA, 23 bp, Arabidopsis thaliana
tgagactgagagtgacagagaga

SEQ ID NO: 4167 - DNA, 20 bp, Arabidopsis thaliana
agctcaggagggatagcgcc

SEQ ID NO: 4168 - DNA, 19 bp, Arabidopsis thaliana
tgactaatgttgttgttga

SEQ ID NO: 4169 - DNA, 20 bp, Arabidopsis thaliana
tctaggtgttgattgcttaa

SEQ ID NO: 4170 - DNA, 21 bp, Arabidopsis thaliana
tatgtgggtgagatggaggca

SEQ ID NO: 4171 - DNA, 21 bp, Arabidopsis thaliana
tgcctggctccctgtatgcca

SEQ ID NO: 4172 - DNA, 19 bp, Arabidopsis thaliana
tgaaaggcaatttgataga

SEQ ID NO: 4173 - DNA, 21 bp, Arabidopsis thaliana
tagagcatcatcaagatgaag

SEQ ID NO: 4174 - DNA, 23 bp, Arabidopsis thaliana
tctcactcgtattcttcatcaac

SEQ ID NO: 4175 - DNA, 19 bp, Arabidopsis thaliana
ggtgctcttcctcttgatg

SEQ ID NO: 4176 - DNA, 20 bp, Arabidopsis thaliana
ttttgttgttgttgttgttg

SEQ ID NO: 4177 - DNA, 23 bp, Arabidopsis thaliana
atgatttgtcttcttcatcgtct

SEQ ID NO: 4178 - DNA, 18 bp, Arabidopsis thaliana
agagttgactgtggagtt

SEQ ID NO: 4179 - DNA, 18 bp, Arabidopsis thaliana
tgtgttgtgtgcttgaag

SEQ ID NO: 4180 - DNA, 23 bp, Arabidopsis thaliana
atcatcatcttcatcatggtcat

SEQ ID NO: 4181 - DNA, 21 bp, Arabidopsis thaliana
aatagtagtgattttgatgat

SEQ ID NO: 4182 - DNA, 22 bp, Arabidopsis thaliana
tttggactgaagggagctcctt

SEQ ID NO: 4183 - DNA, 19 bp, Arabidopsis thaliana
tctgcactttcttcatcct

SEQ ID NO: 4184 - DNA, 21 bp, Arabidopsis thaliana
tttctctgagtttgtgtgtgt

SEQ ID NO: 4185 - DNA, 19 bp, Arabidopsis thaliana
tgacaagaattttttgagt

SEQ ID NO: 4186 - DNA, 20 bp, Arabidopsis thaliana
gtgtttggttttcttcttct

SEQ ID NO: 4187 - DNA, 20 bp, Arabidopsis thaliana
ttttgatgaagattctggtt

SEQ ID NO: 4188 - DNA, 23 bp, Arabidopsis thaliana
cggtgtgtgtgtgcatgatgtgt

SEQ ID NO: 4189 - DNA, 19 bp, Arabidopsis thaliana
ttctgcttcttgttcctct

SEQ ID NO: 4190 - DNA, 21 bp, Arabidopsis thaliana
agagagagagagacgctgtgt

SEQ ID NO: 4191 - DNA, 21 bp, Arabidopsis thaliana
tattgctgcttctgcttcctc

SEQ ID NO: 4192 - DNA, 18 bp, Arabidopsis thaliana
aagagtcaagagacatgc

SEQ ID NO: 4193 - DNA, 20 bp, Arabidopsis thaliana
atgtgttgttgttgttgcac

SEQ ID NO: 4194 - DNA, 23 bp, Arabidopsis thaliana
gtatgtgttgtgtgtttgaactt

SEQ ID NO: 4195 - DNA, 21 bp, Arabidopsis thaliana
gtgtagtgtttggattggagg

SEQ ID NO: 4196 - DNA, 20 bp, Arabidopsis thaliana
tttctgtctgagtaagagga

SEQ ID NO: 4197 - DNA, 23 bp, Arabidopsis thaliana
agtggttagatgatgatgatgga

SEQ ID NO: 4198 - DNA, 23 bp, Arabidopsis thaliana
tactgcgttgtttgatgttgttc

SEQ ID NO: 4199 - DNA, 20 bp, Arabidopsis thaliana
atttctctcattttcttgct

SEQ ID NO: 4200 - DNA, 19 bp, Arabidopsis thaliana
cttgattgtagttgttggg

SEQ ID NO: 4201 - DNA, 21 bp, Arabidopsis thaliana
tatgcaatgttttattgtctg

SEQ ID NO: 4202 - DNA, 23 bp, Arabidopsis thaliana
agcttcttcttcgtcgtcatcgt

SEQ ID NO: 4203 - DNA, 19 bp, Arabidopsis thaliana
tttgtttgttaatcatggt

SEQ ID NO: 4204 - DNA, 20 bp, Arabidopsis thaliana
tcagattgttgatgctgttg

SEQ ID NO: 4205 - DNA, 19 bp, Arabidopsis thaliana
tgtctggtcttcttctaca

SEQ ID NO: 4206 - DNA, 19 bp, Arabidopsis thaliana
tgctgatgttgatgttcgt

SEQ ID NO: 4207 - DNA, 22 bp, Arabidopsis thaliana
tcttgagttgtgtatttgaaga

SEQ ID NO: 4208 - DNA, 19 bp, Arabidopsis thaliana
tagtatgatgatgatggtg

SEQ ID NO: 4209 - DNA, 20 bp, Arabidopsis thaliana
tcttgtgatgatgatgattc

SEQ ID NO: 4210 - DNA, 18 bp, Arabidopsis thaliana
ttcatcttcttcgtcctc

SEQ ID NO: 4211 - DNA, 23 bp, Arabidopsis thaliana
taattcatgttgttggttgttat

SEQ ID NO: 4212 - DNA, 21 bp, Arabidopsis thaliana
aaatgctgcttgtagtagatg

SEQ ID NO: 4213 - DNA, 21 bp, Arabidopsis thaliana
aaggagcagatcaagacactc

SEQ ID NO: 4214 - DNA, 21 bp, Arabidopsis thaliana
tcatgagtgttgaagttgttg

SEQ ID NO: 4215 - DNA, 21 bp, Arabidopsis thaliana
acattgtgaggtttcgtagtt

SEQ ID NO: 4216 - DNA, 23 bp, Arabidopsis thaliana
ttgtgtatgtgcttgggtttaga

SEQ ID NO: 4217 - DNA, 23 bp, Arabidopsis thaliana
ttgtgtgcatgcgtttgtgtgtg

SEQ ID NO: 4218 - DNA, 21 bp, Arabidopsis thaliana
tcgatctcttttgattttggt

SEQ ID NO: 4219 - DNA, 23 bp, Arabidopsis thaliana
ggtggtggaggcgctggtggagc

SEQ ID NO: 4220 - DNA, 23 bp, Arabidopsis thaliana
atatctttgtgttcatttgcttg

SEQ ID NO: 4221 - DNA, 23 bp, Arabidopsis thaliana
ttagttctgtgtggtactatttg

SEQ ID NO: 4222 - DNA, 21 bp, Arabidopsis thaliana
tggagaagcagggcacgtgca

SEQ ID NO: 4223 - DNA, 22 bp, Arabidopsis thaliana
tgactgtgaaatggttggtggt

SEQ ID NO: 4224 - DNA, 20 bp, Arabidopsis thaliana
gattcgaaatgattttgatc

SEQ ID NO: 4225 - DNA, 21 bp, Arabidopsis thaliana
tcatgatcatcatcaccctca

SEQ ID NO: 4226 - DNA, 19 bp, Arabidopsis thaliana
atgagaccgcttttgatct

SEQ ID NO: 4227 - DNA, 23 bp, Arabidopsis thaliana
agattgatgatgatgaagaagaa

SEQ ID NO: 4228 - DNA, 20 bp, Arabidopsis thaliana
tactcaaatgaagatgatct

SEQ ID NO: 4229 - DNA, 20 bp, Arabidopsis thaliana
atatgagatgtgttgttgta

SEQ ID NO: 4230 - DNA, 19 bp, Arabidopsis thaliana
aatcttgctgaccatgtgc

SEQ ID NO: 4231 - DNA, 21 bp, Arabidopsis thaliana
tttgtgtgagtctgtgtgttt

SEQ ID NO: 4232 - DNA, 21 bp, Arabidopsis thaliana
tgtgtgtatgggttacagtgt

SEQ ID NO: 4233 - DNA, 21 bp, Arabidopsis thaliana
cgaaactggtgtcgatcgaca

SEQ ID NO: 4234 - DNA, 20 bp, Arabidopsis thaliana
gttctgctgcagctgctgtt

SEQ ID NO: 4235 - DNA, 20 bp, Arabidopsis thaliana
agtgtgttgatcgacactct

SEQ ID NO: 4236 - DNA, 22 bp, Arabidopsis thaliana
tggaactgagtggatatgctgt

SEQ ID NO: 4237 - DNA, 22 bp, Arabidopsis thaliana
ttgttccttgactcctcagaga

SEQ ID NO: 4238 - DNA, 19 bp, Arabidopsis thaliana
tgcttggcagcaagctgtg

SEQ ID NO: 4239 - DNA, 22 bp, Arabidopsis thaliana
ttggttgttgttgatgtagctg

SEQ ID NO: 4240 - DNA, 23 bp, Arabidopsis thaliana
atgatccagatgatgatgcagtt

SEQ ID NO: 4241 - DNA, 21 bp, Arabidopsis thaliana
tgtggttgttgttgttgcatt

SEQ ID NO: 4242 - DNA, 21 bp, Arabidopsis thaliana
tgagtctttgtctgtgtgtct

SEQ ID NO: 4243 - DNA, 23 bp, Arabidopsis thaliana
ggttctgctgctgctgctgctga

SEQ ID NO: 4244 - DNA, 19 bp, Arabidopsis thaliana
acatcttcatcatctttct

SEQ ID NO: 4245 - DNA, 19 bp, Arabidopsis thaliana
tcagttccagattcagcga

SEQ ID NO: 4246 - DNA, 19 bp, Arabidopsis thaliana
agcagctttgttttggggt

SEQ ID NO: 4247 - DNA, 18 bp, Arabidopsis thaliana
gagagagattatcttgtg

SEQ ID NO: 4248 - DNA, 18 bp, Arabidopsis thaliana
aatcttgatgatgaagca

SEQ ID NO: 4249 - DNA, 21 bp, Arabidopsis thaliana
tgagtcttgtagatgttgcag

SEQ ID NO: 4250 - DNA, 20 bp, Arabidopsis thaliana
ctagtttcatgtgtttgttt

SEQ ID NO: 4251 - DNA, 22 bp, Arabidopsis thaliana
atttgaacttggttgtacttgt

SEQ ID NO: 4252 - DNA, 22 bp, Arabidopsis thaliana
cttcttcatggtgatgatggtc

SEQ ID NO: 4253 - DNA, 18 bp, Arabidopsis thaliana
tgagaaggagagagagga

SEQ ID NO: 4254 - DNA, 22 bp, Arabidopsis thaliana
tcacgttggtgatgttgttctg

SEQ ID NO: 4255 - DNA, 22 bp, Arabidopsis thaliana
acgagagactggtttggtgact

SEQ ID NO: 4256 - DNA, 20 bp, Arabidopsis thaliana
aagaacctgaagaagatgat

SEQ ID NO: 4257 - DNA, 20 bp, Arabidopsis thaliana
agagtgtgtcgatcaacact

SEQ ID NO: 4258 - DNA, 22 bp, Arabidopsis thaliana
agttgagaaggtgattgtggat

SEQ ID NO: 4259 - DNA, 22 bp, Arabidopsis thaliana
tttcgtgtgttcatgttgattg

SEQ ID NO: 4260 - DNA, 21 bp, Arabidopsis thaliana
tacctgtatgttgttgctcca

SEQ ID NO: 4261 - DNA, 19 bp, Arabidopsis thaliana
atcatcttcttcttcctga

SEQ ID NO: 4262 - DNA, 21 bp, Arabidopsis thaliana
tagcagggggagttgctgcag

SEQ ID NO: 4263 - DNA, 18 bp, Arabidopsis thaliana
gcagcacttctatttgct

SEQ ID NO: 4264 - DNA, 19 bp, Arabidopsis thaliana
atagtctggttttgatgtt

SEQ ID NO: 4265 - DNA, 18 bp, Arabidopsis thaliana
agtggaaagtttgatgtg

SEQ ID NO: 4266 - DNA, 21 bp, Arabidopsis thaliana
agacttggtttgttgcaggtg

SEQ ID NO: 4267 - DNA, 18 bp, Arabidopsis thaliana
catgcagatgatgttgtt

SEQ ID NO: 4268 - DNA, 20 bp, Arabidopsis thaliana
taaatacatatagctttggt

SEQ ID NO: 4269 - DNA, 19 bp, Arabidopsis thaliana
acaaggttgtgctctctct

SEQ ID NO: 4270 - DNA, 18 bp, Arabidopsis thaliana
gaagatgaaatttgttga

SEQ ID NO: 4271 - DNA, 20 bp, Arabidopsis thaliana
ttgagcttgtatgttgttga

SEQ ID NO: 4272 - DNA, 20 bp, Arabidopsis thaliana
gagctgttgatgcagatggt

SEQ ID NO: 4273 - DNA, 22 bp, Arabidopsis thaliana
atcatgtgtgatgttgttcaaa

SEQ ID NO: 4274 - DNA, 23 bp, Arabidopsis thaliana
tatgtttgagattcttgctgatg

SEQ ID NO: 4275 - DNA, 21 bp, Arabidopsis thaliana
ggttcgtacgtacactgttca

SEQ ID NO: 4276 - DNA, 18 bp, Arabidopsis thaliana
ttagattgggtttgatct

SEQ ID NO: 4277 - DNA, 23 bp, Arabidopsis thaliana
ggttcgtacgtacactgttcatc

SEQ ID NO: 4278 - DNA, 23 bp, Arabidopsis thaliana
agatgctgatgatgatgatgaag

SEQ ID NO: 4279 - DNA, 21 bp, Arabidopsis thaliana
tgatatgtacttgagcttaga

SEQ ID NO: 4280 - DNA, 18 bp, Arabidopsis thaliana
gtgcattgttgttggttt

SEQ ID NO: 4281 - DNA, 21 bp, Arabidopsis thaliana
agcgattgttgatgaacgtcc

SEQ ID NO: 4282 - DNA, 23 bp, Arabidopsis thaliana
ttatgttttttgaagcttgatct

SEQ ID NO: 4283 - DNA, 18 bp, Arabidopsis thaliana
gaagagtgttggtgatgt

SEQ ID NO: 4284 - DNA, 22 bp, Arabidopsis thaliana
acattcttcttcttcttgatga

SEQ ID NO: 4285 - DNA, 23 bp, Arabidopsis thaliana
ttgatgatgatgatgctgatgct

SEQ ID NO: 4286 - DNA, 19 bp, Arabidopsis thaliana
tgtgttgctcttgctctgt

SEQ ID NO: 4287 - DNA, 23 bp, Arabidopsis thaliana
ttcatgtatgtacatgtacatgt

SEQ ID NO: 4288 - DNA, 21 bp, Arabidopsis thaliana
tgacgttgttgatgctgctga

SEQ ID NO: 4289 - DNA, 19 bp, Arabidopsis thaliana
acgatgttgatgctgctga

SEQ ID NO: 4290 - DNA, 22 bp, Arabidopsis thaliana
agtttctacatcttcttggtca

SEQ ID NO: 4291 - DNA, 21 bp, Arabidopsis thaliana
atgtggtgttgcagctggaag

SEQ ID NO: 4292 - DNA, 23 bp, Arabidopsis thaliana
tgtctgtggatttgagaaagttg

SEQ ID NO: 4293 - DNA, 22 bp, Arabidopsis thaliana
tttacagaggctttgttcttct

SEQ ID NO: 4294 - DNA, 23 bp, Arabidopsis thaliana
tgatccctgcttgttgaatcgaa

SEQ ID NO: 4295 - DNA, 23 bp, Arabidopsis thaliana
atgcatgtgtgcatgtgtttgtg

SEQ ID NO: 4296 - DNA, 20 bp, Arabidopsis thaliana
tggagtatgaagatgaagat

SEQ ID NO: 4297 - DNA, 19 bp, Arabidopsis thaliana
actttatgatgattgttgt

SEQ ID NO: 4298 - DNA, 20 bp, Arabidopsis thaliana
tgtgctcactctcttctgtc

SEQ ID NO: 4299 - DNA, 19 bp, Arabidopsis thaliana
attctggtgattttgatgt

SEQ ID NO: 4300 - DNA, 21 bp, Arabidopsis thaliana
acgtgaggaactttcttgaag

SEQ ID NO: 4301 - DNA, 18 bp, Arabidopsis thaliana
agtgtctctctctttctc

SEQ ID NO: 4302 - DNA, 22 bp, Arabidopsis thaliana
ttggtcttcttggtgcaagtgg

SEQ ID NO: 4303 - DNA, 19 bp, Arabidopsis thaliana
tgtgcaatgttgaatctgt

SEQ ID NO: 4304 - DNA, 19 bp, Arabidopsis thaliana
tgtttcgtcttcttgatca

SEQ ID NO: 4305 - DNA, 19 bp, Arabidopsis thaliana
acactccaaattttcttca

SEQ ID NO: 4306 - DNA, 23 bp, Arabidopsis thaliana
gtcttgttcttcagtggcttcct

SEQ ID NO: 4307 - DNA, 20 bp, Arabidopsis thaliana
aaggtgtgtgtatgtggtca

SEQ ID NO: 4308 - DNA, 23 bp, Arabidopsis thaliana
tgagtgagagagagcgtcactgt

SEQ ID NO: 4309 - DNA, 20 bp, Arabidopsis thaliana
tgatgatcatcttcttcctg

SEQ ID NO: 4310 - DNA, 23 bp, Arabidopsis thaliana
agcaagaagaagaagattcacaa

SEQ ID NO: 4311 - DNA, 21 bp, Arabidopsis thaliana
acactgtcttgttgtgatgtt

SEQ ID NO: 4312 - DNA, 18 bp, Arabidopsis thaliana
attctacttcaggtttgt

SEQ ID NO: 4313 - DNA, 22 bp, Arabidopsis thaliana
ataatgcttttgtttagaggat

SEQ ID NO: 4314 - DNA, 23 bp, Arabidopsis thaliana
tgtttttctgtgtgtgagagatt

SEQ ID NO: 4315 - DNA, 23 bp, Arabidopsis thaliana
tggatctctctctgtgtctgtga

SEQ ID NO: 4316 - DNA, 21 bp, Arabidopsis thaliana
tgattggaaatttcgttgact

SEQ ID NO: 4317 - DNA, 21 bp, Arabidopsis thaliana
ttctgctatgttgctgctcat

SEQ ID NO: 4318 - DNA, 19 bp, Arabidopsis thaliana
atatagatattgtggtatg

SEQ ID NO: 4319 - DNA, 19 bp, Arabidopsis thaliana
tctctccttttgaatccat

SEQ ID NO: 4320 - DNA, 19 bp, Arabidopsis thaliana
agacattgatgtttgtgca

SEQ ID NO: 4321 - DNA, 20 bp, Arabidopsis thaliana
tgattgtatgattttggtga

SEQ ID NO: 4322 - DNA, 19 bp, Arabidopsis thaliana
atctctttgtagatgttca

SEQ ID NO: 4323 - DNA, 23 bp, Arabidopsis thaliana
tgagttgggtctaacccataact

SEQ ID NO: 4324 - DNA, 18 bp, Arabidopsis thaliana
tcaaccagtctctctctt

SEQ ID NO: 4325 - DNA, 19 bp, Arabidopsis thaliana
tgtgaagggcaatgttctt

SEQ ID NO: 4326 - DNA, 19 bp, Arabidopsis thaliana
tctcacatgatcatcatca

SEQ ID NO: 4327 - DNA, 23 bp, Arabidopsis thaliana
ttgcttgttgatgatgttgtgag

SEQ ID NO: 4328 - DNA, 18 bp, Arabidopsis thaliana
agtggatcaatgatgagc

SEQ ID NO: 4329 - DNA, 22 bp, Arabidopsis thaliana
gcggttgcgattggtgtttgtg

SEQ ID NO: 4330 - DNA, 22 bp, Arabidopsis thaliana
tatgtgtgtgaacattttgaaa

SEQ ID NO: 4331 - DNA, 20 bp, Arabidopsis thaliana
tgcattgaatttgcattgtt

SEQ ID NO: 4332 - DNA, 22 bp, Arabidopsis thaliana
tgaatcttcttcttcttgctta

SEQ ID NO: 4333 - DNA, 19 bp, Arabidopsis thaliana
attgcaaaattaggtttgt

SEQ ID NO: 4334 - DNA, 19 bp, Arabidopsis thaliana
tgtgtaagtgtgtgtgtat

SEQ ID NO: 4335 - DNA, 18 bp, Arabidopsis thaliana
tagcatcgtgaccatgtg

SEQ ID NO: 4336 - DNA, 23 bp, Arabidopsis thaliana
agaagatgatgatgatgatgatg

SEQ ID NO: 4337 - DNA, 23 bp, Arabidopsis thaliana
ggtgtgaggctggtgatgatgtt

SEQ ID NO: 4338 - DNA, 18 bp, Arabidopsis thaliana
actctctggtttggtttt

SEQ ID NO: 4339 - DNA, 21 bp, Arabidopsis thaliana
tggtgatggtggtggtgctga

SEQ ID NO: 4340 - DNA, 20 bp, Arabidopsis thaliana
ttatagatgttgatggtgat

SEQ ID NO: 4341 - DNA, 18 bp, Arabidopsis thaliana
ttgttaatggctgaggtt

SEQ ID NO: 4342 - DNA, 19 bp, Arabidopsis thaliana
gtgcctctggtggtgcagc

SEQ ID NO: 4343 - DNA, 19 bp, Arabidopsis thaliana
tctcgttgtctctctctgt

SEQ ID NO: 4344 - DNA, 22 bp, Arabidopsis thaliana
attgttcttgatgttggagctg

SEQ ID NO: 4345 - DNA, 22 bp, Arabidopsis thaliana
cgacagaagagagtgagcacac

SEQ ID NO: 4346 - DNA, 20 bp, Arabidopsis thaliana
tgtctcctgctctctccctc

SEQ ID NO: 4347 - DNA, 18 bp, Arabidopsis thaliana
gaaaggtaatgatgcaaa

SEQ ID NO: 4348 - DNA, 23 bp, Arabidopsis thaliana
atggtgactttggtgatgatgga

SEQ ID NO: 4349 - DNA, 18 bp, Arabidopsis thaliana
ttgctgatgttgttgctg

SEQ ID NO: 4350 - DNA, 21 bp, Arabidopsis thaliana
tgagtgtatgtatatgcatgt

SEQ ID NO: 4351 - DNA, 19 bp, Arabidopsis thaliana
agtgaatgtgtgtctctct

SEQ ID NO: 4352 - DNA, 18 bp, Arabidopsis thaliana
ttagcatggttgtgatct

SEQ ID NO: 4353 - DNA, 23 bp, Arabidopsis thaliana
aattgtatgatgttgttgattga

SEQ ID NO: 4354 - DNA, 21 bp, Arabidopsis thaliana
aggtatttgaagaagaagaag

SEQ ID NO: 4355 - DNA, 19 bp, Arabidopsis thaliana
tgtctttgagcaggtgact

SEQ ID NO: 4356 - DNA, 22 bp, Arabidopsis thaliana
atgtgtgtgttgatgatgatga

SEQ ID NO: 4357 - DNA, 20 bp, Arabidopsis thaliana
gttcttgatcatcatcatca

SEQ ID NO: 4358 - DNA, 21 bp, Arabidopsis thaliana
tgctgctgatactgctggtgg

SEQ ID NO: 4359 - DNA, 18 bp, Arabidopsis thaliana
agatatgtttgataaatt

SEQ ID NO: 4360 - DNA, 20 bp, Arabidopsis thaliana
tatgtacatacatgtttatg

SEQ ID NO: 4361 - DNA, 18 bp, Arabidopsis thaliana
tgcatctgcatctgaaac

SEQ ID NO: 4362 - DNA, 21 bp, Arabidopsis thaliana
tatgaggttggttgttgtatt

SEQ ID NO: 4363 - DNA, 23 bp, Arabidopsis thaliana
atcatcttcatcatcaatctggt

SEQ ID NO: 4364 - DNA, 23 bp, Arabidopsis thaliana
tttggttgtgtttacatttactt

SEQ ID NO: 4365 - DNA, 21 bp, Arabidopsis thaliana
tgaggaagttgattgtttcca

SEQ ID NO: 4366 - DNA, 19 bp, Arabidopsis thaliana
tctcatcgtcgtcttccac

SEQ ID NO: 4367 - DNA, 19 bp, Arabidopsis thaliana
tggtgctaagtagctcttt

SEQ ID NO: 4368 - DNA, 19 bp, Arabidopsis thaliana
atgatgttgttgtaggtga

SEQ ID NO: 4369 - DNA, 23 bp, Arabidopsis thaliana
ttggtggagctggtgtagcggtt

SEQ ID NO: 4370 - DNA, 21 bp, Arabidopsis thaliana
acattgctgctgaagaagtgt

SEQ ID NO: 4371 - DNA, 20 bp, Arabidopsis thaliana
ttgtcagttattcttggttt

SEQ ID NO: 4372 - DNA, 20 bp, Arabidopsis thaliana
aagagtctgtttttcgatga

SEQ ID NO: 4373 - DNA, 19 bp, Arabidopsis thaliana
tcttagaagatgttccagt

SEQ ID NO: 4374 - DNA, 18 bp, Arabidopsis thaliana
tgtttggttttgatttca

SEQ ID NO: 4375 - DNA, 18 bp, Arabidopsis thaliana
tctgtgatgatgaagata

SEQ ID NO: 4376 - DNA, 23 bp, Arabidopsis thaliana
gtgatcattgtggttggtttgag

SEQ ID NO: 4377 - DNA, 22 bp, Arabidopsis thaliana
tcagcgtcagcagcagcaggac

SEQ ID NO: 4378 - DNA, 20 bp, Arabidopsis thaliana
ttgttgttgaagaagaagaa

SEQ ID NO: 4379 - DNA, 18 bp, Arabidopsis thaliana
ttattgttgatgtagctg

SEQ ID NO: 4380 - DNA, 20 bp, Arabidopsis thaliana
atgcttgtgttcttgttgag

SEQ ID NO: 4381 - DNA, 18 bp, Arabidopsis thaliana
tgagattcgtttttgagt

SEQ ID NO: 4382 - DNA, 21 bp, Arabidopsis thaliana
ggttcgtacgtacgctgttca

SEQ ID NO: 4383 - DNA, 20 bp, Arabidopsis thaliana
tttgtatgttgaagaatttt

SEQ ID NO: 4384 - DNA, 21 bp, Arabidopsis thaliana
agtaactggtgtcgatcgaca

SEQ ID NO: 4385 - DNA, 21 bp, Arabidopsis thaliana
tcactgcttttagtgctttca

SEQ ID NO: 4386 - DNA, 18 bp, Arabidopsis thaliana
gaaactggtgtcgatcgt

SEQ ID NO: 4387 - DNA, 21 bp, Arabidopsis thaliana
cgaaactggtgtcgatcgaca

SEQ ID NO: 4388 - DNA, 23 bp, Arabidopsis thaliana
tcatgcgattgttgtttgttctg

SEQ ID NO: 4389 - DNA, 20 bp, Arabidopsis thaliana
ttgtcagttattcttggttt

SEQ ID NO: 4390 - DNA, 18 bp, Arabidopsis thaliana
tgagagagattgttaaag

SEQ ID NO: 4391 - DNA, 18 bp, Arabidopsis thaliana
tgaaccctggtggtggat

SEQ ID NO: 4392 - DNA, 19 bp, Arabidopsis thaliana
tctctattcactgtgttca

SEQ ID NO: 4393 - DNA, 19 bp, Arabidopsis thaliana
aaagcacattttcaagtac

SEQ ID NO: 4394 - DNA, 22 bp, Arabidopsis thaliana
tgagtactctcttccaaagttg

SEQ ID NO: 4395 - DNA, 19 bp, Arabidopsis thaliana
tctgtgtgaattttgatgt

SEQ ID NO: 4396 - DNA, 19 bp, Arabidopsis thaliana
tcacatccttatcttcttc

SEQ ID NO: 4397 - DNA, 18 bp, Arabidopsis thaliana
tgaatgatgatggtgata

SEQ ID NO: 4398 - DNA, 20 bp, Arabidopsis thaliana
cgacacactcttggtttcga

SEQ ID NO: 4399 - DNA, 20 bp, Arabidopsis thaliana
tgagcaacaatattgatgtg

SEQ ID NO: 4400 - DNA, 20 bp, Arabidopsis thaliana
accttgttgttgctgtggtg

SEQ ID NO: 4401 - DNA, 19 bp, Arabidopsis thaliana
atgtgctgcagcaggtggg

SEQ ID NO: 4402 - DNA, 23 bp, Arabidopsis thaliana
actccatgctgtggctctgtggg

SEQ ID NO: 4403 - DNA, 20 bp, Arabidopsis thaliana
atctctctctctatgttctg

SEQ ID NO: 4404 - DNA, 19 bp, Arabidopsis thaliana
ttcacttttgcattgatga

SEQ ID NO: 4405 - DNA, 19 bp, Arabidopsis thaliana
gtatcaggtgtcgatcgac

SEQ ID NO: 4406 - DNA, 18 bp, Arabidopsis thaliana
tcagcgggtgaaggagtg

SEQ ID NO: 4407 - DNA, 21 bp, Arabidopsis thaliana
aagaatggtgatgatgatctt

SEQ ID NO: 4408 - DNA, 23 bp, Arabidopsis thaliana
tgagttttgtagatgttgcagat

SEQ ID NO: 4409 - DNA, 18 bp, Arabidopsis thaliana
ttgttgttgatgtagctg

SEQ ID NO: 4410 - DNA, 21 bp, Arabidopsis thaliana
cgaaactggtgtcgatcgaca

SEQ ID NO: 4411 - DNA, 23 bp, Arabidopsis thaliana
agctgttgatgttgttgatcatc

SEQ ID NO: 4412 - DNA, 21 bp, Arabidopsis thaliana
ggttcgtacgtacactgttca

SEQ ID NO: 4413 - DNA, 23 bp, Arabidopsis thaliana
tcacgttggtgatgttgttctga

SEQ ID NO: 4414 - DNA, 23 bp, Arabidopsis thaliana
agagaagtgatcatgatcagtgt

SEQ ID NO: 4415 - DNA, 22 bp, Arabidopsis thaliana
tctttggttgtagtgagaggat

SEQ ID NO: 4416 - DNA, 23 bp, Arabidopsis thaliana
gatcatcatcatcatgatgctgt

SEQ ID NO: 4417 - DNA, 20 bp, Arabidopsis thaliana
taaattctttttgaaatcca

SEQ ID NO: 4418 - DNA, 22 bp, Arabidopsis thaliana
agtgaatcgtgatgatgatgat

SEQ ID NO: 4419 - DNA, 18 bp, Arabidopsis thaliana
ttgaattttgttgttgtt

SEQ ID NO: 4420 - DNA, 19 bp, Arabidopsis thaliana
tagagtcagattttgtgtt

SEQ ID NO: 4421 - DNA, 20 bp, Arabidopsis thaliana
aagtttgtgtagatctagat

SEQ ID NO: 4422 - DNA, 21 bp, Arabidopsis thaliana
aatgtcatcatcatcatcagt

SEQ ID NO: 4423 - DNA, 21 bp, Arabidopsis thaliana
acttgggagatgaagatctga

SEQ ID NO: 4424 - DNA, 20 bp, Arabidopsis thaliana
actcgtttgaaactgagttc

SEQ ID NO: 4425 - DNA, 18 bp, Arabidopsis thaliana
ggttcattgtaggaagac

SEQ ID NO: 4426 - DNA, 20 bp, Arabidopsis thaliana
ctttgaagaagttgtttgat

SEQ ID NO: 4427 - DNA, 21 bp, Arabidopsis thaliana
agagagagagagtgagaggct

SEQ ID NO: 4428 - DNA, 22 bp, Arabidopsis thaliana
acactgaaggacctaaactaac

SEQ ID NO: 4429 - DNA, 21 bp, Arabidopsis thaliana
gacctctgaatcgagagcatg

SEQ ID NO: 4430 - DNA, 21 bp, Arabidopsis thaliana
agattgttgatgttgttgttg

SEQ ID NO: 4431 - DNA, 18 bp, Arabidopsis thaliana
tgaatggtgttgttgttg

SEQ ID NO: 4432 - DNA, 23 bp, Arabidopsis thaliana
tcttcttcttcatcatcatcttc

SEQ ID NO: 4433 - DNA, 23 bp, Arabidopsis thaliana
ttgatatgtgtgtgagtgtgttt

SEQ ID NO: 4434 - DNA, 19 bp, Arabidopsis thaliana
tatgatgatgatggtgcaa

SEQ ID NO: 4435 - DNA, 23 bp, Arabidopsis thaliana
ggagaggtttaagtttgtggtat

SEQ ID NO: 4436 - DNA, 20 bp, Arabidopsis thaliana
agattggtgatgatggtcaa

SEQ ID NO: 4437 - DNA, 19 bp, Arabidopsis thaliana
tctgattgggaatgatgtt

SEQ ID NO: 4438 - DNA, 18 bp, Arabidopsis thaliana
attcaagcatttggtctc

SEQ ID NO: 4439 - DNA, 20 bp, Arabidopsis thaliana
agctgctgatgttattcacc

SEQ ID NO: 4440 - DNA, 23 bp, Arabidopsis thaliana
cttcttcttcatcatcatcaatc

SEQ ID NO: 4441 - DNA, 21 bp, Arabidopsis thaliana
aagagcattatgcatgtatgg

SEQ ID NO: 4442 - DNA, 19 bp, Arabidopsis thaliana
atatttacacacacacata

SEQ ID NO: 4443 - DNA, 23 bp, Arabidopsis thaliana
tcaacatcttcaagaacctgcag

SEQ ID NO: 4444 - DNA, 23 bp, Arabidopsis thaliana
aatgtgtgtgtgtgtatgtgcag

SEQ ID NO: 4445 - DNA, 19 bp, Arabidopsis thaliana
aggaggcgcagagagggag

SEQ ID NO: 4446 - DNA, 19 bp, Arabidopsis thaliana
tctctctctgtctctgtcc

SEQ ID NO: 4447 - DNA, 23 bp, Arabidopsis thaliana
tatctacgtgtgtgtgtgaatga

SEQ ID NO: 4448 - DNA, 23 bp, Arabidopsis thaliana
gtcttggttctgctcggtgtcct

SEQ ID NO: 4449 - DNA, 23 bp, Arabidopsis thaliana
ggacgtggaggccgtggtggtcg

SEQ ID NO: 4450 - DNA, 21 bp, Arabidopsis thaliana
cactgactttcttcttcttcg

SEQ ID NO: 4451 - DNA, 21 bp, Arabidopsis thaliana
atgatgctgatgatcgtggtg

SEQ ID NO: 4452 - DNA, 21 bp, Arabidopsis thaliana
tcaagagtgatcatctttgtg

SEQ ID NO: 4453 - DNA, 23 bp, Arabidopsis thaliana
agtgcttgtgctatctgtgatgg

SEQ ID NO: 4454 - DNA, 21 bp, Arabidopsis thaliana
tgatcacatttgaagttgtag

SEQ ID NO: 4455 - DNA, 20 bp, Arabidopsis thaliana
catcatcatcatcatcaaga

SEQ ID NO: 4456 - DNA, 21 bp, Arabidopsis thaliana
tgcaggaggatgtgttgtgct

SEQ ID NO: 4457 - DNA, 19 bp, Arabidopsis thaliana
atgtttcttctgttgctgt

SEQ ID NO: 4458 - DNA, 23 bp, Arabidopsis thaliana
aatcatgtgagtgcatgtgcatc

SEQ ID NO: 4459 - DNA, 21 bp, Arabidopsis thaliana
tgagcttggaggttgattagt

SEQ ID NO: 4460 - DNA, 20 bp, Arabidopsis thaliana
taagtctgtgtgtatgtgaa

SEQ ID NO: 4461 - DNA, 23 bp, Arabidopsis thaliana
aactcgttcctctctctgtgtgt

SEQ ID NO: 4462 - DNA, 18 bp, Arabidopsis thaliana
aatctcagtctctttctc

SEQ ID NO: 4463 - DNA, 23 bp, Arabidopsis thaliana
atgcatttgttcttgttgattga

SEQ ID NO: 4464 - DNA, 20 bp, Arabidopsis thaliana
tcattcttattcttcgtctt

SEQ ID NO: 4465 - DNA, 21 bp, Arabidopsis thaliana
tttgcagtttgtgcttgaaga

SEQ ID NO: 4466 - DNA, 19 bp, Arabidopsis thaliana
tctgctgatggagcagctg

SEQ ID NO: 4467 - DNA, 18 bp, Arabidopsis thaliana
tgtgtgtgtatttggtac

SEQ ID NO: 4468 - DNA, 18 bp, Arabidopsis thaliana
tggagacttggtttgttg

SEQ ID NO: 4469 - DNA, 22 bp, Arabidopsis thaliana
attcttcttcatcatcttcagc

SEQ ID NO: 4470 - DNA, 18 bp, Arabidopsis thaliana
tgcattccatatctttct

SEQ ID NO: 4471 - DNA, 18 bp, Arabidopsis thaliana
ttggttgttgatgtagcg

SEQ ID NO: 4472 - DNA, 19 bp, Arabidopsis thaliana
catcgtgttgaagttgttg

SEQ ID NO: 4473 - DNA, 18 bp, Arabidopsis thaliana
tttgtgatcttcctcacc

SEQ ID NO: 4474 - DNA, 20 bp, Arabidopsis thaliana
aactcaggatggatagcgcc

SEQ ID NO: 4475 - DNA, 23 bp, Arabidopsis thaliana
tgtgtgtgtgtctgcctctctgt

SEQ ID NO: 4476 - DNA, 18 bp, Arabidopsis thaliana
aatctgttgttgtttgag

SEQ ID NO: 4477 - DNA, 20 bp, Arabidopsis thaliana
aaactcatgatcgtctctct

SEQ ID NO: 4478 - DNA, 20 bp, Arabidopsis thaliana
tctctcgtcttcttcgtctg

SEQ ID NO: 4479 - DNA, 19 bp, Arabidopsis thaliana
tgcttggtttgtacgtgtg

SEQ ID NO: 4480 - DNA, 21 bp, Arabidopsis thaliana
tctggtacttgattgttgcta

SEQ ID NO: 4481 - DNA, 18 bp, Arabidopsis thaliana
tcactgacttaatgttct

SEQ ID NO: 4482 - DNA, 21 bp, Arabidopsis thaliana
aagtgtaagcactttgtggtt

SEQ ID NO: 4483 - DNA, 19 bp, Arabidopsis thaliana
tttgtgtatgcatgttcta

SEQ ID NO: 4484 - DNA, 22 bp, Arabidopsis thaliana
gatggttatgtgtgcttgtgca

SEQ ID NO: 4485 - DNA, 20 bp, Arabidopsis thaliana
tggttgtgtgaatgattgct

SEQ ID NO: 4486 - DNA, 23 bp, Arabidopsis thaliana
tttgtgtgagtgagagagagagt

SEQ ID NO: 4487 - DNA, 19 bp, Arabidopsis thaliana
tggtgttgtgtttctattg

SEQ ID NO: 4488 - DNA, 22 bp, Arabidopsis thaliana
tggttgtgtgatgatcttctag

SEQ ID NO: 4489 - DNA, 18 bp, Arabidopsis thaliana
aaagtctggtttgcatca

SEQ ID NO: 4490 - DNA, 21 bp, Arabidopsis thaliana
catgtcattgattttcttgca

SEQ ID NO: 4491 - DNA, 18 bp, Arabidopsis thaliana
atgtaatatgttgttggg

SEQ ID NO: 4492 - DNA, 20 bp, Arabidopsis thaliana
tcagatgatgctcattgtgc

SEQ ID NO: 4493 - DNA, 18 bp, Arabidopsis thaliana
ctggagtttagacagttg

SEQ ID NO: 4494 - DNA, 21 bp, Arabidopsis thaliana
aatcctttctgtggttgttga

SEQ ID NO: 4495 - DNA, 21 bp, Arabidopsis thaliana
tcttgtggggattgctgtggt

SEQ ID NO: 4496 - DNA, 21 bp, Arabidopsis thaliana
tgccaaaggagatttgccccg

SEQ ID NO: 4497 - DNA, 23 bp, Arabidopsis thaliana
tcgtttgattgctcttgttgggt

SEQ ID NO: 4498 - DNA, 23 bp, Arabidopsis thaliana
tgagagagtgtgtgtgtgtgtgc

SEQ ID NO: 4499 - DNA, 18 bp, Arabidopsis thaliana
gtctctctctatttctct

SEQ ID NO: 4500 - DNA, 20 bp, Arabidopsis thaliana
gcatctgctggaggaggagg

SEQ ID NO: 4501 - DNA, 19 bp, Arabidopsis thaliana
tgtttcctgtccctgtgct

SEQ ID NO: 4502 - DNA, 20 bp, Arabidopsis thaliana
ttgcacatgctgctgcagag

SEQ ID NO: 4503 - DNA, 21 bp, Arabidopsis thaliana
gaaggtagtgaatttgttcga

SEQ ID NO: 4504 - DNA, 18 bp, Arabidopsis thaliana
tgatgaatgatgcaggag

SEQ ID NO: 4505 - DNA, 21 bp, Arabidopsis thaliana
ttggttgatgatgttggagct

SEQ ID NO: 4506 - DNA, 19 bp, Arabidopsis thaliana
tgaatcttcttcttcttct

SEQ ID NO: 4507 - DNA, 23 bp, Arabidopsis thaliana
atgatgtagttgttgttgttgct

SEQ ID NO: 4508 - DNA, 21 bp, Arabidopsis thaliana
taaagaaacttgagtgtgatg

SEQ ID NO: 4509 - DNA, 22 bp, Arabidopsis thaliana
tatgtgctttgttgttctggtt

SEQ ID NO: 4510 - DNA, 22 bp, Arabidopsis thaliana
gtggtgatggtggtggtgctga

SEQ ID NO: 4511 - DNA, 22 bp, Arabidopsis thaliana
tattagttgttgatgctggaga

SEQ ID NO: 4512 - DNA, 18 bp, Arabidopsis thaliana
cagactaagtttgttctt

SEQ ID NO: 4513 - DNA, 19 bp, Arabidopsis thaliana
tgatttgttttgtagctta

SEQ ID NO: 4514 - DNA, 19 bp, Arabidopsis thaliana
tgacctcatcttcttcttc

SEQ ID NO: 4515 - DNA, 20 bp, Arabidopsis thaliana
aaactgatctctctgtattg

SEQ ID NO: 4516 - DNA, 23 bp, Arabidopsis thaliana
tctctgattttgataggtactga

SEQ ID NO: 4517 - DNA, 23 bp, Arabidopsis thaliana
tgtttccatggagtgtgtgtgtg

SEQ ID NO: 4518 - DNA, 18 bp, Arabidopsis thaliana
ttagaggaggaaaaaggt

SEQ ID NO: 4519 - DNA, 18 bp, Arabidopsis thaliana
atggtgttgatgatgcag

SEQ ID NO: 4520 - DNA, 19 bp, Arabidopsis thaliana
taagtgtttctctttcgag

SEQ ID NO: 4521 - DNA, 19 bp, Arabidopsis thaliana
agatgtgtttgcgtttgga

SEQ ID NO: 4522 - DNA, 18 bp, Arabidopsis thaliana
tgagaatcatcaagcatt

SEQ ID NO: 4523 - DNA, 23 bp, Arabidopsis thaliana
gttatgtgtgtgtatgactctgt

SEQ ID NO: 4524 - DNA, 18 bp, Arabidopsis thaliana
tattggtgatgttgttgt

SEQ ID NO: 4525 - DNA, 22 bp, Arabidopsis thaliana
aaatctcatgatgaatctgtga

SEQ ID NO: 4526 - DNA, 18 bp, Arabidopsis thaliana
tgcagcattgaaattgtg

SEQ ID NO: 4527 - DNA, 20 bp, Arabidopsis thaliana
tggagcaggagaagcttcag

SEQ ID NO: 4528 - DNA, 20 bp, Arabidopsis thaliana
acttgaaattgaaaggtttt

SEQ ID NO: 4529 - DNA, 19 bp, Arabidopsis thaliana
tgactctgtttcttcttct

SEQ ID NO: 4530 - DNA, 18 bp, Arabidopsis thaliana
aaatgtcaaattgatttg

SEQ ID NO: 4531 - DNA, 18 bp, Arabidopsis thaliana
cgtccatctctgtgcttg

SEQ ID NO: 4532 - DNA, 18 bp, Arabidopsis thaliana
ctcgtgatggtggtggtg

SEQ ID NO: 4533 - DNA, 20 bp, Arabidopsis thaliana
ttgagcaggagatggattca

SEQ ID NO: 4534 - DNA, 21 bp, Arabidopsis thaliana
agaggtagctgcttgttgtgt

SEQ ID NO: 4535 - DNA, 21 bp, Arabidopsis thaliana
tctgtgtcgtcgtcgtcgtca

SEQ ID NO: 4536 - DNA, 20 bp, Arabidopsis thaliana
atagacaaaggtggtgcaga

SEQ ID NO: 4537 - DNA, 22 bp, Arabidopsis thaliana
taattcttcttctagctgcatc

SEQ ID NO: 4538 - DNA, 23 bp, Arabidopsis thaliana
tgcagagattgatgatgtagatg

SEQ ID NO: 4539 - DNA, 23 bp, Arabidopsis thaliana
caatgtgcatctgcatctgaatg

SEQ ID NO: 4540 - DNA, 21 bp, Arabidopsis thaliana
ccactgctggtggtggtggtg

SEQ ID NO: 4541 - DNA, 23 bp, Arabidopsis thaliana
tggctgttgctgttgctgtggag

SEQ ID NO: 4542 - DNA, 20 bp, Arabidopsis thaliana
ttttgtttctttggctttgc

SEQ ID NO: 4543 - DNA, 18 bp, Arabidopsis thaliana
tcagtggttggtctgagt

SEQ ID NO: 4544 - DNA, 22 bp, Arabidopsis thaliana
agtttcgaacctgaggcagaga

SEQ ID NO: 4545 - DNA, 18 bp, Arabidopsis thaliana
agtagtcttcaagtagat

SEQ ID NO: 4546 - DNA, 19 bp, Arabidopsis thaliana
aaactgtgtgtttatgaga

SEQ ID NO: 4547 - DNA, 21 bp, Arabidopsis thaliana
acactgttgttggtgcaggta

SEQ ID NO: 4548 - DNA, 21 bp, Arabidopsis thaliana
tgacagaagagagtgagcaca

SEQ ID NO: 4549 - DNA, 21 bp, Arabidopsis thaliana
tcactgctctttctgtcagat

SEQ ID NO: 4550 - DNA, 20 bp, Arabidopsis thaliana
attctgatgttgctgtgact

SEQ ID NO: 4551 - DNA, 18 bp, Arabidopsis thaliana
acagaggaatgagagtga

SEQ ID NO: 4552 - DNA, 23 bp, Arabidopsis thaliana
agcttcttcttctacctctctgt

SEQ ID NO: 4553 - DNA, 23 bp, Arabidopsis thaliana
tgtttgacgtagtttcttgttct

SEQ ID NO: 4554 - DNA, 19 bp, Arabidopsis thaliana
tcctctgttgttggtgtct

SEQ ID NO: 4555 - DNA, 21 bp, Arabidopsis thaliana
tgaattgttcttgttcttgca

SEQ ID NO: 4556 - DNA, 19 bp, Arabidopsis thaliana
atacatgcacacagtcaca

SEQ ID NO: 4557 - DNA, 20 bp, Arabidopsis thaliana
tagtctgtcgttgtttttgt

SEQ ID NO: 4558 - DNA, 21 bp, Arabidopsis thaliana
tcgtcttccttgtcttcctca

SEQ ID NO: 4559 - DNA, 20 bp, Arabidopsis thaliana
aagtttgtgtagatctagat

SEQ ID NO: 4560 - DNA, 23 bp, Arabidopsis thaliana
tgtgtgtgtgtcagtgtgtgtca

SEQ ID NO: 4561 - DNA, 23 bp, Arabidopsis thaliana
tatgagtgagtgtgtgtgtgatt

SEQ ID NO: 4562 - DNA, 21 bp, Arabidopsis thaliana
tagtagagtgttgatgagtga

SEQ ID NO: 4563 - DNA, 23 bp, Arabidopsis thaliana
tggtaagattgcttataagctgg

SEQ ID NO: 4564 - DNA, 23 bp, Arabidopsis thaliana
ttcgttgttgttgttggattgtt

SEQ ID NO: 4565 - DNA, 19 bp, Arabidopsis thaliana
aggctagagattgtgttgt

SEQ ID NO: 4566 - DNA, 19 bp, Arabidopsis thaliana
aagtcttgtgattttggtc

SEQ ID NO: 4567 - DNA, 20 bp, Arabidopsis thaliana
tgtgtttgtgtgtgttcatg

SEQ ID NO: 4568 - DNA, 20 bp, Arabidopsis thaliana
atctgtgttcttgttcactc

SEQ ID NO: 4569 - DNA, 19 bp, Arabidopsis thaliana
atctcaatgatgaagatga

SEQ ID NO: 4570 - DNA, 21 bp, Arabidopsis thaliana
ggtttgtacgtacactgttca

SEQ ID NO: 4571 - DNA, 18 bp, Arabidopsis thaliana
gtatgaatgtatgtatgt

SEQ ID NO: 4572 - DNA, 23 bp, Arabidopsis thaliana
atgtatgaatgcatgaatgcatg

SEQ ID NO: 4573 - DNA, 21 bp, Arabidopsis thaliana
atgtatgaatgcatgaatgaa

SEQ ID NO: 4574 - DNA, 22 bp, Arabidopsis thaliana
atgtatgaatgcatgaatgcat

SEQ ID NO: 4575 - DNA, 22 bp, Arabidopsis thaliana
atgtatgaatgcatgtatgtat

SEQ ID NO: 4576 - DNA, 19 bp, Arabidopsis thaliana
tagatcgttttagtttctt

SEQ ID NO: 4577 - DNA, 21 bp, Arabidopsis thaliana
attagtgttcttgatgttgat

SEQ ID NO: 4578 - DNA, 21 bp, Arabidopsis thaliana
attagtgttcttgatgttgat

SEQ ID NO: 4579 - DNA, 19 bp, Arabidopsis thaliana
agacttgtgtttctgatgt

SEQ ID NO: 4580 - DNA, 19 bp, Arabidopsis thaliana
tatgatgatgattcctgat

SEQ ID NO: 4581 - DNA, 18 bp, Arabidopsis thaliana
acaatcttctgatgctaa

SEQ ID NO: 4582 - DNA, 18 bp, Arabidopsis thaliana
aaagttatgtacgtttat

SEQ ID NO: 4583 - DNA, 18 bp, Arabidopsis thaliana
tttgtgtgttcatataca

SEQ ID NO: 4584 - DNA, 22 bp, Arabidopsis thaliana
tgaatgtatggatgtatgaatg

SEQ ID NO: 4585 - DNA, 23 bp, Arabidopsis thaliana
atgtatgaatgcatgaatgcaag

SEQ ID NO: 4586 - DNA, 21 bp, Arabidopsis thaliana
tatgtgcgacgatgttccagt

SEQ ID NO: 4587 - DNA, 20 bp, Arabidopsis thaliana
ttgtcagttattcttggttt

SEQ ID NO: 4588 - DNA, 19 bp, Arabidopsis thaliana
ttgatttctcttgaaggtt

SEQ ID NO: 4589 - DNA, 23 bp, Arabidopsis thaliana
ttagtcattcttggtttgttggt

SEQ ID NO: 4590 - DNA, 20 bp, Arabidopsis thaliana
aagtttgtgtagatctagat

SEQ ID NO: 4591 - DNA, 19 bp, Arabidopsis thaliana
tactgctgtgaacttgggt

SEQ ID NO: 4592 - DNA, 23 bp, Arabidopsis thaliana
acacaatcgtcatcgtggtggtg

SEQ ID NO: 4593 - DNA, 18 bp, Arabidopsis thaliana
tgtggtttgcatggtggt

SEQ ID NO: 4594 - DNA, 19 bp, Arabidopsis thaliana
tcttgtatcaatttgatgc

SEQ ID NO: 4595 - DNA, 23 bp, Arabidopsis thaliana
aggtcattgacgatgatcatcat

SEQ ID NO: 4596 - DNA, 18 bp, Arabidopsis thaliana
ttgttgttgatgtagctg

SEQ ID NO: 4597 - DNA, 20 bp, Arabidopsis thaliana
ttgtgaattgtttctgttgt

SEQ ID NO: 4598 - DNA, 21 bp, Arabidopsis thaliana
tgaatgcaaatgttgctgatc

SEQ ID NO: 4599 - DNA, 21 bp, Arabidopsis thaliana
aactgtttgatgttggtgtca

SEQ ID NO: 4600 - DNA, 21 bp, Arabidopsis thaliana
agaatgaagctccagatctga

SEQ ID NO: 4601 - DNA, 23 bp, Arabidopsis thaliana
tctttggtgttttcaggtgtatg

SEQ ID NO: 4602 - DNA, 18 bp, Arabidopsis thaliana
tttgtgtgtgtccttctc

SEQ ID NO: 4603 - DNA, 22 bp, Arabidopsis thaliana
ctttggtgttttcaggtgtatg

SEQ ID NO: 4604 - DNA, 18 bp, Arabidopsis thaliana
tcacaggttgcctttgct

SEQ ID NO: 4605 - DNA, 21 bp, Arabidopsis thaliana
aattgtttgttgttggagtcc

SEQ ID NO: 4606 - DNA, 18 bp, Arabidopsis thaliana
tttgagttgttgttctta

SEQ ID NO: 4607 - DNA, 20 bp, Arabidopsis thaliana
aagtttgtgtagatctagat

SEQ ID NO: 4608 - DNA, 22 bp, Arabidopsis thaliana
acttttgtcatgttgttgtagt

SEQ ID NO: 4609 - DNA, 23 bp, Arabidopsis thaliana
tgatatgtatgattatgatgttt

SEQ ID NO: 4610 - DNA, 23 bp, Arabidopsis thaliana
gagctgaggaggcagttgagact

SEQ ID NO: 4611 - DNA, 22 bp, Arabidopsis thaliana
ctttggtgttttcaggtgtatg

SEQ ID NO: 4612 - DNA, 18 bp, Arabidopsis thaliana
agatgatagagtcgtcca

SEQ ID NO: 4613 - DNA, 19 bp, Arabidopsis thaliana
tcgatgtgtttctcattga

SEQ ID NO: 4614 - DNA, 20 bp, Arabidopsis thaliana
ttctagagcaaatttgatct

SEQ ID NO: 4615 - DNA, 23 bp, Arabidopsis thaliana
gtggtaacagagcacactctgaa

SEQ ID NO: 4616 - DNA, 19 bp, Arabidopsis thaliana
gtgtgtgaatgtaagctga

SEQ ID NO: 4617 - DNA, 19 bp, Arabidopsis thaliana
agaggatgatggttggtag

SEQ ID NO: 4618 - DNA, 23 bp, Arabidopsis thaliana
taagagtctgagagagtgtgtgt

SEQ ID NO: 4619 - DNA, 18 bp, Arabidopsis thaliana
ttgttgttgatgtagctg

SEQ ID NO: 4620 - DNA, 19 bp, Arabidopsis thaliana
cttctggagctgctgcagc

SEQ ID NO: 4621 - DNA, 18 bp, Arabidopsis thaliana
tgaggttcctgtaagaat

SEQ ID NO: 4622 - DNA, 20 bp, Arabidopsis thaliana
actctctccatatgattgac

SEQ ID NO: 4623 - DNA, 21 bp, Arabidopsis thaliana
tatgatcaagtttgtttttgt

SEQ ID NO: 4624 - DNA, 18 bp, Arabidopsis thaliana
gatagatatacttccttg

SEQ ID NO: 4625 - DNA, 20 bp, Arabidopsis thaliana
ttacactgttgttatcatgt

SEQ ID NO: 4626 - DNA, 21 bp, Arabidopsis thaliana
tgagtagtgaataggtttctg

SEQ ID NO: 4627 - DNA, 20 bp, Arabidopsis thaliana
ttacactgttgttatcatgt

SEQ ID NO: 4628 - DNA, 21 bp, Arabidopsis thaliana
tgagtagtgaataggtttctg

SEQ ID NO: 4629 - DNA, 20 bp, Arabidopsis thaliana
tctgcaatgatgtttgagta

SEQ ID NO: 4630 - DNA, 20 bp, Arabidopsis thaliana
agttccatcttatttgagga

SEQ ID NO: 4631 - DNA, 20 bp, Arabidopsis thaliana
agagtgtgtcgatcaacact

SEQ ID NO: 4632 - DNA, 19 bp, Arabidopsis thaliana
ctggtgtcgatcgacaccc

SEQ ID NO: 4633 - DNA, 21 bp, Arabidopsis thaliana
ttgttgatggttgtggattcg

SEQ ID NO: 4634 - DNA, 21 bp, Arabidopsis thaliana
agttgaatgttgaggatgttg

SEQ ID NO: 4635 - DNA, 20 bp, Arabidopsis thaliana
tgatgtgagttcttggagta

SEQ ID NO: 4636 - DNA, 21 bp, Arabidopsis thaliana
cgaaactggtgtcgatcgaca

SEQ ID NO: 4637 - DNA, 19 bp, Arabidopsis thaliana
gaactttggtggtggattc

SEQ ID NO: 4638 - DNA, 23 bp, Arabidopsis thaliana
agagtgtctctctctcacactct

SEQ ID NO: 4639 - DNA, 21 bp, Arabidopsis thaliana
acattgctgctgaagaagtgt

SEQ ID NO: 4640 - DNA, 23 bp, Arabidopsis thaliana
tgatcagtgttcttgaactctaa

SEQ ID NO: 4641 - DNA, 22 bp, Arabidopsis thaliana
actgtcagctgctgttctgctg

SEQ ID NO: 4642 - DNA, 19 bp, Arabidopsis thaliana
agaagatgaaatttgttga

SEQ ID NO: 4643 - DNA, 19 bp, Arabidopsis thaliana
acgtttgcttcttcttctt

SEQ ID NO: 4644 - DNA, 23 bp, Arabidopsis thaliana
tcattttgttgttgatgcaggta

SEQ ID NO: 4645 - DNA, 19 bp, Arabidopsis thaliana
agtctgtgatgtgatgaga

SEQ ID NO: 4646 - DNA, 20 bp, Arabidopsis thaliana
tgatcttctagaatgctata

SEQ ID NO: 4647 - DNA, 18 bp, Arabidopsis thaliana
tcagcttcttcatcatcc

SEQ ID NO: 4648 - DNA, 20 bp, Arabidopsis thaliana
tgaggaagaacctaggaaga

SEQ ID NO: 4649 - DNA, 21 bp, Arabidopsis thaliana
aaagtggctgcagttgatgtt

SEQ ID NO: 4650 - DNA, 22 bp, Arabidopsis thaliana
tgctcttgctttgatgatggtg

SEQ ID NO: 4651 - DNA, 18 bp, Arabidopsis thaliana
ttcaggatctgcatcgtt

SEQ ID NO: 4652 - DNA, 23 bp, Arabidopsis thaliana
accatgttgttggtgcagtgcat

SEQ ID NO: 4653 - DNA, 19 bp, Arabidopsis thaliana
tatgatgatggttgtatag

SEQ ID NO: 4654 - DNA, 21 bp, Arabidopsis thaliana
taactaaacattggtctagta

SEQ ID NO: 4655 - DNA, 22 bp, Arabidopsis thaliana
tagttggtgctgatgttgatgg

SEQ ID NO: 4656 - DNA, 21 bp, Arabidopsis thaliana
tctgatcgacattcttgatga

SEQ ID NO: 4657 - DNA, 19 bp, Arabidopsis thaliana
atgcttcttcatcttggtg

SEQ ID NO: 4658 - DNA, 18 bp, Arabidopsis thaliana
gaggaatctaagtttgtg

SEQ ID NO: 4659 - DNA, 21 bp, Arabidopsis thaliana
tctttggttttctaggttagt

SEQ ID NO: 4660 - DNA, 21 bp, Arabidopsis thaliana
tccttctttgttgttgctgac

SEQ ID NO: 4661 - DNA, 20 bp, Arabidopsis thaliana
aatgactgatttgtttgtat

SEQ ID NO: 4662 - DNA, 18 bp, Arabidopsis thaliana
ctgtcacttgttccactc

SEQ ID NO: 4663 - DNA, 19 bp, Arabidopsis thaliana
ttttgctatttttggaatc

SEQ ID NO: 4664 - DNA, 23 bp, Arabidopsis thaliana
tatgtttgatattctgtgtggtt

SEQ ID NO: 4665 - DNA, 23 bp, Arabidopsis thaliana
aagatgatgatgatgatgatggt

SEQ ID NO: 4666 - DNA, 19 bp, Arabidopsis thaliana
ttgactcttgttgctattg

SEQ ID NO: 4667 - DNA, 18 bp, Arabidopsis thaliana
tgtcatgtgtgcatggag

SEQ ID NO: 4668 - DNA, 21 bp, Arabidopsis thaliana
tttggattatggtgctgatgt

SEQ ID NO: 4669 - DNA, 21 bp, Arabidopsis thaliana
ttagcattgttgttgatgact

SEQ ID NO: 4670 - DNA, 19 bp, Arabidopsis thaliana
agactctgctgaggtaaca

SEQ ID NO: 4671 - DNA, 23 bp, Arabidopsis thaliana
ttggtgtgtgagtgagtgactaa

SEQ ID NO: 4672 - DNA, 19 bp, Arabidopsis thaliana
acacatttgaagttgttga

SEQ ID NO: 4673 - DNA, 20 bp, Arabidopsis thaliana
gttgtctttgggtgtgtttt

SEQ ID NO: 4674 - DNA, 21 bp, Arabidopsis thaliana
tgtctgtgaacgtgtgtgttt

SEQ ID NO: 4675 - DNA, 19 bp, Arabidopsis thaliana
agaggtgcaattttgtaga

SEQ ID NO: 4676 - DNA, 21 bp, Arabidopsis thaliana
ttctgtgtagctatgaacttg

SEQ ID NO: 4677 - DNA, 20 bp, Arabidopsis thaliana
tgagggggagagatcgtgga

SEQ ID NO: 4678 - DNA, 21 bp, Arabidopsis thaliana
tcagcttcttcttcttccact

SEQ ID NO: 4679 - DNA, 21 bp, Arabidopsis thaliana
aaagtgtgtggttctggtgag

SEQ ID NO: 4680 - DNA, 21 bp, Arabidopsis thaliana
tttaggtcgagcttcattgga

SEQ ID NO: 4681 - DNA, 18 bp, Arabidopsis thaliana
acagcaggtggacaagcc

SEQ ID NO: 4682 - DNA, 23 bp, Arabidopsis thaliana
agacacaactttgactttgtggt

SEQ ID NO: 4683 - DNA, 21 bp, Arabidopsis thaliana
accgagctcttcttcttcctg

SEQ ID NO: 4684 - DNA, 23 bp, Arabidopsis thaliana
gtttgtatatgtgtgtgtctgtg

SEQ ID NO: 4685 - DNA, 20 bp, Arabidopsis thaliana
atcagactggtaaaattgag

SEQ ID NO: 4686 - DNA, 18 bp, Arabidopsis thaliana
agtttggatatcttactg

SEQ ID NO: 4687 - DNA, 18 bp, Arabidopsis thaliana
tgatgatggttgttgttg

SEQ ID NO: 4688 - DNA, 19 bp, Arabidopsis thaliana
atggagattgattttgatt

SEQ ID NO: 4689 - DNA, 21 bp, Arabidopsis thaliana
tgaatcatcatcatcatcttc

SEQ ID NO: 4690 - DNA, 19 bp, Arabidopsis thaliana
tgggtttgttgatgatggt

SEQ ID NO: 4691 - DNA, 19 bp, Arabidopsis thaliana
catgtgtgtgtatgtgtgt

SEQ ID NO: 4692 - DNA, 18 bp, Arabidopsis thaliana
atgaccctgattgttcat

SEQ ID NO: 4693 - DNA, 23 bp, Arabidopsis thaliana
tcggattgagtttgctggttgtt

SEQ ID NO: 4694 - DNA, 18 bp, Arabidopsis thaliana
tgaacttcatctttgatg

SEQ ID NO: 4695 - DNA, 18 bp, Arabidopsis thaliana
aaacttcttggatgatgt

SEQ ID NO: 4696 - DNA, 18 bp, Arabidopsis thaliana
gtaagatggatcatttgg

SEQ ID NO: 4697 - DNA, 21 bp, Arabidopsis thaliana
ggttcagtggaaatttggttg

SEQ ID NO: 4698 - DNA, 21 bp, Arabidopsis thaliana
gctgagactgcgtgttcttct

SEQ ID NO: 4699 - DNA, 23 bp, Arabidopsis thaliana
aaagattgcttgtacatggaggt

SEQ ID NO: 4700 - DNA, 18 bp, Arabidopsis thaliana
agagagagagagtgagtg

SEQ ID NO: 4701 - DNA, 21 bp, Arabidopsis thaliana
tgtcttcattgttgatgttgt

SEQ ID NO: 4702 - DNA, 22 bp, Arabidopsis thaliana
tctgctacttcttcttcctcga

SEQ ID NO: 4703 - DNA, 20 bp, Arabidopsis thaliana
tatgtgtgaatgcatctcca

SEQ ID NO: 4704 - DNA, 21 bp, Arabidopsis thaliana
gtttatgtggatgctgtgtct

SEQ ID NO: 4705 - DNA, 18 bp, Arabidopsis thaliana
agtgtctttctctcttct

SEQ ID NO: 4706 - DNA, 18 bp, Arabidopsis thaliana
atgttccatattgttgat

SEQ ID NO: 4707 - DNA, 18 bp, Arabidopsis thaliana
ggtagtagtaagtggtgt

SEQ ID NO: 4708 - DNA, 18 bp, Arabidopsis thaliana
tgagatgaaccagaggag

SEQ ID NO: 4709 - DNA, 19 bp, Arabidopsis thaliana
tgtcttttttctgaattga

SEQ ID NO: 4710 - DNA, 20 bp, Arabidopsis thaliana
tgtgaatgtgtttgtgtcac

SEQ ID NO: 4711 - DNA, 18 bp, Arabidopsis thaliana
agtgcatccttaaaaggc

SEQ ID NO: 4712 - DNA, 19 bp, Arabidopsis thaliana
ttctctcttcttcttgact

SEQ ID NO: 4713 - DNA, 18 bp, Arabidopsis thaliana
tagtgggttggtaagatg

SEQ ID NO: 4714 - DNA, 18 bp, Arabidopsis thaliana
tcacttcatggtgatttc

SEQ ID NO: 4715 - DNA, 18 bp, Arabidopsis thaliana
atgttgatgattgatgtt

SEQ ID NO: 4716 - DNA, 19 bp, Arabidopsis thaliana
ctctgtttcccaatcatca

SEQ ID NO: 4717 - DNA, 19 bp, Arabidopsis thaliana
ttgagcttcttcttcctct

SEQ ID NO: 4718 - DNA, 18 bp, Arabidopsis thaliana
gagaagatgaagaacgag

SEQ ID NO: 4719 - DNA, 23 bp, Arabidopsis thaliana
tgtttggttctagtatgtgcaat

SEQ ID NO: 4720 - DNA, 20 bp, Arabidopsis thaliana
tttgatgaagtttgtggtgt

SEQ ID NO: 4721 - DNA, 18 bp, Arabidopsis thaliana
agtggtttagttagcttg

SEQ ID NO: 4722 - DNA, 20 bp, Arabidopsis thaliana
tttgtttgcagaggaatatg

SEQ ID NO: 4723 - DNA, 18 bp, Arabidopsis thaliana
ccatgtaacgttgctgtg

SEQ ID NO: 4724 - DNA, 18 bp, Arabidopsis thaliana
gagctatatggatccatg

SEQ ID NO: 4725 - DNA, 18 bp, Arabidopsis thaliana
tccaagcatttagtgtgt

SEQ ID NO: 4726 - DNA, 22 bp, Arabidopsis thaliana
gagaatcttgatgatgctgcag

SEQ ID NO: 4727 - DNA, 21 bp, Arabidopsis thaliana
aggccgtggtggcggtggagg

SEQ ID NO: 4728 - DNA, 18 bp, Arabidopsis thaliana
ttagctgttgtttgtgat

SEQ ID NO: 4729 - DNA, 18 bp, Arabidopsis thaliana
tcttcttcttcttcaact

SEQ ID NO: 4730 - DNA, 21 bp, Arabidopsis thaliana
actgtttgtgtctctctgtgt

SEQ ID NO: 4731 - DNA, 21 bp, Arabidopsis thaliana
tgcgtcatgaatccattttgt

SEQ ID NO: 4732 - DNA, 23 bp, Arabidopsis thaliana
tgtgtctgtgtgtgtctgagtct

SEQ ID NO: 4733 - DNA, 18 bp, Arabidopsis thaliana
ttgtgtgtatgtatctag

SEQ ID NO: 4734 - DNA, 23 bp, Arabidopsis thaliana
gtttgtacttgttggatgatgat

SEQ ID NO: 4735 - DNA, 20 bp, Arabidopsis thaliana
tgattggaaatcttgcaatt

SEQ ID NO: 4736 - DNA, 21 bp, Arabidopsis thaliana
aaaggaatgaagggagctcgt

SEQ ID NO: 4737 - DNA, 19 bp, Arabidopsis thaliana
gagatctatgagaaggctg

SEQ ID NO: 4738 - DNA, 22 bp, Arabidopsis thaliana
aacctccaggtgttgatggttc

SEQ ID NO: 4739 - DNA, 21 bp, Arabidopsis thaliana
atccatggtgtttcttcttct

SEQ ID NO: 4740 - DNA, 23 bp, Arabidopsis thaliana
tgacagaagagagagagcacagc

SEQ ID NO: 4741 - DNA, 21 bp, Arabidopsis thaliana
aatctgtgctattgttgttta

SEQ ID NO: 4742 - DNA, 22 bp, Arabidopsis thaliana
tgatgatgatgattgtggttat

SEQ ID NO: 4743 - DNA, 18 bp, Arabidopsis thaliana
ttgtagtgttgtggatca

SEQ ID NO: 4744 - DNA, 22 bp, Arabidopsis thaliana
gttttctgatgttggtgaatca

SEQ ID NO: 4745 - DNA, 19 bp, Arabidopsis thaliana
tgtgcttcttgtttgattg

SEQ ID NO: 4746 - DNA, 23 bp, Arabidopsis thaliana
attggttttctctgtgattgtgt

SEQ ID NO: 4747 - DNA, 19 bp, Arabidopsis thaliana
agtctctctctctctctct

SEQ ID NO: 4748 - DNA, 20 bp, Arabidopsis thaliana
ttgagtgatgatctagttga

SEQ ID NO: 4749 - DNA, 23 bp, Arabidopsis thaliana
tctcaccgtgagttgatctagat

SEQ ID NO: 4750 - DNA, 19 bp, Arabidopsis thaliana
acaacatggagaagaagga

SEQ ID NO: 4751 - DNA, 20 bp, Arabidopsis thaliana
actgcatttgatctctcttt

SEQ ID NO: 4752 - DNA, 19 bp, Arabidopsis thaliana
tgtctctgctggacttgtg

SEQ ID NO: 4753 - DNA, 19 bp, Arabidopsis thaliana
ttgtccatgattgatgatg

SEQ ID NO: 4754 - DNA, 18 bp, Arabidopsis thaliana
agtcttggagagagagga

SEQ ID NO: 4755 - DNA, 18 bp, Arabidopsis thaliana
agagaggttagctttgga

SEQ ID NO: 4756 - DNA, 18 bp, Arabidopsis thaliana
tgttctgtttcctagttt

SEQ ID NO: 4757 - DNA, 19 bp, Arabidopsis thaliana
agcatttgtgatgttggag

SEQ ID NO: 4758 - DNA, 21 bp, Arabidopsis thaliana
aaagtcttcttgagcatcact

SEQ ID NO: 4759 - DNA, 20 bp, Arabidopsis thaliana
atcttgttctggttctgagt

SEQ ID NO: 4760 - DNA, 21 bp, Arabidopsis thaliana
tagtgatgtcttgttggtttc

SEQ ID NO: 4761 - DNA, 21 bp, Arabidopsis thaliana
tgtgtgaagttgtgtgtctac

SEQ ID NO: 4762 - DNA, 18 bp, Arabidopsis thaliana
tttgcagcggctgatgtg

SEQ ID NO: 4763 - DNA, 21 bp, Arabidopsis thaliana
agatgatcaagattcttgttt

SEQ ID NO: 4764 - DNA, 19 bp, Arabidopsis thaliana
ttgtgttcatggtggtggt

SEQ ID NO: 4765 - DNA, 21 bp, Arabidopsis thaliana
tcggaccaggcttcattcccc

SEQ ID NO: 4766 - DNA, 19 bp, Arabidopsis thaliana
accatcatgatcatcgtca

SEQ ID NO: 4767 - DNA, 23 bp, Arabidopsis thaliana
tagagcttgatgatgatgatgat

SEQ ID NO: 4768 - DNA, 23 bp, Arabidopsis thaliana
tatgtgtctgtgtctgtttgtgc

SEQ ID NO: 4769 - DNA, 19 bp, Arabidopsis thaliana
atgtgacatgatttcttgt

SEQ ID NO: 4770 - DNA, 20 bp, Arabidopsis thaliana
tctctcctactttgttcttg

SEQ ID NO: 4771 - DNA, 19 bp, Arabidopsis thaliana
atagtgatgctttgatgat

SEQ ID NO: 4772 - DNA, 22 bp, Arabidopsis thaliana
catgaagcagttgttgttgttc

SEQ ID NO: 4773 - DNA, 23 bp, Arabidopsis thaliana
tgaaggagtgggtcactgctgtt

SEQ ID NO: 4774 - DNA, 19 bp, Arabidopsis thaliana
atgaggatggtggtgctga

SEQ ID NO: 4775 - DNA, 19 bp, Arabidopsis thaliana
agaggatgatcgttggatg

SEQ ID NO: 4776 - DNA, 23 bp, Arabidopsis thaliana
atcatcatcatcatcatcatcat

SEQ ID NO: 4777 - DNA, 20 bp, Arabidopsis thaliana
agtcttggagcagatcggga

SEQ ID NO: 4778 - DNA, 19 bp, Arabidopsis thaliana
tcctcactgggaaagctgt

SEQ ID NO: 4779 - DNA, 21 bp, Arabidopsis thaliana
tgaagctgccagcatgatcta

SEQ ID NO: 4780 - DNA, 19 bp, Arabidopsis thaliana
aatctgctgatgctggtgg

SEQ ID NO: 4781 - DNA, 18 bp, Arabidopsis thaliana
agagtgatgatgctgata

SEQ ID NO: 4782 - DNA, 18 bp, Arabidopsis thaliana
tttgtgttgttgttgtca

SEQ ID NO: 4783 - DNA, 19 bp, Arabidopsis thaliana
tacactgttgttatcttgt

SEQ ID NO: 4784 - DNA, 23 bp, Arabidopsis thaliana
ctctactcttcatgttgttgttg

SEQ ID NO: 4785 - DNA, 19 bp, Arabidopsis thaliana
ttgtcagtgttcttgatga

SEQ ID NO: 4786 - DNA, 19 bp, Arabidopsis thaliana
agagaagatgcagaattga

SEQ ID NO: 4787 - DNA, 22 bp, Arabidopsis thaliana
ttagtactactctttggttgtg

SEQ ID NO: 4788 - DNA, 22 bp, Arabidopsis thaliana
ggaagcggaggaggtggtggtg

SEQ ID NO: 4789 - DNA, 20 bp, Arabidopsis thaliana
gaagcggaggaggaggtggt

SEQ ID NO: 4790 - DNA, 18 bp, Arabidopsis thaliana
gagaagacagagatttca

SEQ ID NO: 4791 - DNA, 21 bp, Arabidopsis thaliana
tcaatcaggtaagtctctctg

SEQ ID NO: 4792 - DNA, 19 bp, Arabidopsis thaliana
tatctgttgttcttgtgtc

SEQ ID NO: 4793 - DNA, 23 bp, Arabidopsis thaliana
agagaaagtgagtgtgtctgtga

SEQ ID NO: 4794 - DNA, 20 bp, Arabidopsis thaliana
tggctctggtttggttgctg

SEQ ID NO: 4795 - DNA, 18 bp, Arabidopsis thaliana
ggagctcttcattcagca

SEQ ID NO: 4796 - DNA, 21 bp, Arabidopsis thaliana
agggtgagagtgagagtgaga

SEQ ID NO: 4797 - DNA, 21 bp, Arabidopsis thaliana
ttgattggtgttgatgttgga

SEQ ID NO: 4798 - DNA, 20 bp, Arabidopsis thaliana
ttggaagggattttgttggt

SEQ ID NO: 4799 - DNA, 19 bp, Arabidopsis thaliana
tcagagagagagagagaga

SEQ ID NO: 4800 - DNA, 19 bp, Arabidopsis thaliana
ttcttcttcttcttcgaca

SEQ ID NO: 4801 - DNA, 23 bp, Arabidopsis thaliana
aggttatgatgatgttggtggtg

SEQ ID NO: 4802 - DNA, 21 bp, Arabidopsis thaliana
tgcatagacacaaagatcaca

SEQ ID NO: 4803 - DNA, 23 bp, Arabidopsis thaliana
agtgtttgagtgcatgtgtgtgt

SEQ ID NO: 4804 - DNA, 23 bp, Arabidopsis thaliana
tctgggttcttcttgttcatctt

SEQ ID NO: 4805 - DNA, 18 bp, Arabidopsis thaliana
tttggtattgttggttaa

SEQ ID NO: 4806 - DNA, 19 bp, Arabidopsis thaliana
actctcctcttcttcgcct

SEQ ID NO: 4807 - DNA, 23 bp, Arabidopsis thaliana
tatgtgtgtgtgtgtgaacatgt

SEQ ID NO: 4808 - DNA, 20 bp, Arabidopsis thaliana
tacaccagcaaaacgcttgt

SEQ ID NO: 4809 - DNA, 23 bp, Arabidopsis thaliana
tgtaaagtgtgatgttgtagttt

SEQ ID NO: 4810 - DNA, 19 bp, Arabidopsis thaliana
aaagcaatgttgctggtgt

SEQ ID NO: 4811 - DNA, 18 bp, Arabidopsis thaliana
aggtagaatatagatgta

SEQ ID NO: 4812 - DNA, 19 bp, Arabidopsis thaliana
agtgatctgtttttgttgt

SEQ ID NO: 4813 - DNA, 21 bp, Arabidopsis thaliana
ccagagagtttggggaaatgt

SEQ ID NO: 4814 - DNA, 18 bp, Arabidopsis thaliana
ttttgcttttgttcttgt

SEQ ID NO: 4815 - DNA, 20 bp, Arabidopsis thaliana
attcatcaggttgatagatc

SEQ ID NO: 4816 - DNA, 23 bp, Arabidopsis thaliana
tcaagatcttcttcatcttcaac

SEQ ID NO: 4817 - DNA, 19 bp, Arabidopsis thaliana
ttgttcgtcatcatcgtca

SEQ ID NO: 4818 - DNA, 22 bp, Arabidopsis thaliana
tttcatgcactggctctctgtc

SEQ ID NO: 4819 - DNA, 20 bp, Arabidopsis thaliana
tgcggcggaggaggagctgg

SEQ ID NO: 4820 - DNA, 19 bp, Arabidopsis thaliana
ttcttatgtgtggttgtgt

SEQ ID NO: 4821 - DNA, 19 bp, Arabidopsis thaliana
agaaatgtgtctggacatc

SEQ ID NO: 4822 - DNA, 20 bp, Arabidopsis thaliana
gagttggaggagttggggag

SEQ ID NO: 4823 - DNA, 18 bp, Arabidopsis thaliana
tgatattggtgtgtctca

SEQ ID NO: 4824 - DNA, 23 bp, Arabidopsis thaliana
agcaagaggaagaagatgaagat

SEQ ID NO: 4825 - DNA, 23 bp, Arabidopsis thaliana
tcatgatcatgatcatcatcatg

SEQ ID NO: 4826 - DNA, 18 bp, Arabidopsis thaliana
agcttgtttcattttgtt

SEQ ID NO: 4827 - DNA, 23 bp, Arabidopsis thaliana
tcatcatcatcatcttcttctag

SEQ ID NO: 4828 - DNA, 23 bp, Arabidopsis thaliana
ttgagtggaagattgaagatctt

SEQ ID NO: 4829 - DNA, 18 bp, Arabidopsis thaliana
gtgtgtgttctcaagtca

SEQ ID NO: 4830 - DNA, 20 bp, Arabidopsis thaliana
tggcaggctgttgatttgca

SEQ ID NO: 4831 - DNA, 23 bp, Arabidopsis thaliana
tggctgtgtgtcattgtggttgt

SEQ ID NO: 4832 - DNA, 20 bp, Arabidopsis thaliana
ttaagtgacgtattgatgtt

SEQ ID NO: 4833 - DNA, 19 bp, Arabidopsis thaliana
tgtggtagaagtaactgat

SEQ ID NO: 4834 - DNA, 18 bp, Arabidopsis thaliana
aactgtttgttttctgaa

SEQ ID NO: 4835 - DNA, 19 bp, Arabidopsis thaliana
tgttaggtattcttgatct

SEQ ID NO: 4836 - DNA, 19 bp, Arabidopsis thaliana
gttgaatgttgtgggtgta

SEQ ID NO: 4837 - DNA, 21 bp, Arabidopsis thaliana
ttgtttgctcatttagttgat

SEQ ID NO: 4838 - DNA, 19 bp, Arabidopsis thaliana
ctggcggtggtgctggtgg

SEQ ID NO: 4839 - DNA, 18 bp, Arabidopsis thaliana
tcgggtggtggtggtggc

SEQ ID NO: 4840 - DNA, 18 bp, Arabidopsis thaliana
tgtgagttcttggactaa

SEQ ID NO: 4841 - DNA, 23 bp, Arabidopsis thaliana
atcagagagagagtgtgtgtgag

SEQ ID NO: 4842 - DNA, 19 bp, Arabidopsis thaliana
acacacacaggctgtctct

SEQ ID NO: 4843 - DNA, 20 bp, Arabidopsis thaliana
gttagaactagaatctgaga

SEQ ID NO: 4844 - DNA, 23 bp, Arabidopsis thaliana
tagatacacacacacatagttgt

SEQ ID NO: 4845 - DNA, 18 bp, Arabidopsis thaliana
cttggtcttgttttcatg

SEQ ID NO: 4846 - DNA, 22 bp, Arabidopsis thaliana
tcagctgaggttcttgggaaag

SEQ ID NO: 4847 - DNA, 18 bp, Arabidopsis thaliana
gactggcggtggtggtgg

SEQ ID NO: 4848 - DNA, 21 bp, Arabidopsis thaliana
cttcttaagtgctgataatgc

SEQ ID NO: 4849 - DNA, 22 bp, Arabidopsis thaliana
ttctgcttccttgttattgatc

SEQ ID NO: 4850 - DNA, 18 bp, Arabidopsis thaliana
tgttgctggtgctggtgc

SEQ ID NO: 4851 - DNA, 23 bp, Arabidopsis thaliana
acaacttgaagtttgtcgatgaa

SEQ ID NO: 4852 - DNA, 19 bp, Arabidopsis thaliana
ttgtggttgatgttgcagg

SEQ ID NO: 4853 - DNA, 23 bp, Arabidopsis thaliana
tatgcttctgtatgctcgttcat

SEQ ID NO: 4854 - DNA, 18 bp, Arabidopsis thaliana
atttgcattaactggatt

SEQ ID NO: 4855 - DNA, 20 bp, Arabidopsis thaliana
caagttgcatgtgttggtgt

SEQ ID NO: 4856 - DNA, 20 bp, Arabidopsis thaliana
catgttcatcatcatggtca

SEQ ID NO: 4857 - DNA, 23 bp, Arabidopsis thaliana
tgatcttgatgatgatcatggtg

SEQ ID NO: 4858 - DNA, 18 bp, Arabidopsis thaliana
cgtggtgatcttgttgtg

SEQ ID NO: 4859 - DNA, 23 bp, Arabidopsis thaliana
gtgtgtgtcagtgtgtgtgactt

SEQ ID NO: 4860 - DNA, 21 bp, Arabidopsis thaliana
cagtgcaatattgttcttgat

SEQ ID NO: 4861 - DNA, 22 bp, Arabidopsis thaliana
aattgcactgtgtgtttggact

SEQ ID NO: 4862 - DNA, 18 bp, Arabidopsis thaliana
agaattcaagcagagttg

SEQ ID NO: 4863 - DNA, 20 bp, Arabidopsis thaliana
tttcttgtttgaatgctcct

SEQ ID NO: 4864 - DNA, 20 bp, Arabidopsis thaliana
tgaagctgccagcatgatct

SEQ ID NO: 4865 - DNA, 19 bp, Arabidopsis thaliana
atcagtctcgattagatca

SEQ ID NO: 4866 - DNA, 23 bp, Arabidopsis thaliana
tatcatcgtcatggtcatcgtca

SEQ ID NO: 4867 - DNA, 22 bp, Arabidopsis thaliana
tgatcatgatcatcatcgtcgt

SEQ ID NO: 4868 - DNA, 19 bp, Arabidopsis thaliana
gtaagtgatgaacctgtct

SEQ ID NO: 4869 - DNA, 22 bp, Arabidopsis thaliana
ttcgcttgcagagagaaatcac

SEQ ID NO: 4870 - DNA, 23 bp, Arabidopsis thaliana
ttgcatttgttgttgttgctgca

SEQ ID NO: 4871 - DNA, 21 bp, Arabidopsis thaliana
agaccctctctctttctctct

SEQ ID NO: 4872 - DNA, 20 bp, Arabidopsis thaliana
tttgtgtgtgtgaaattcca

SEQ ID NO: 4873 - DNA, 21 bp, Arabidopsis thaliana
ttcagagaatgtttcatgtgt

SEQ ID NO: 4874 - DNA, 23 bp, Arabidopsis thaliana
ttatgatcatcatcatcatcaac

SEQ ID NO: 4875 - DNA, 22 bp, Arabidopsis thaliana
taactgcttcaactactagatg

SEQ ID NO: 4876 - DNA, 21 bp, Arabidopsis thaliana
ttccgattgttgttgatggaa

SEQ ID NO: 4877 - DNA, 21 bp, Arabidopsis thaliana
ttgcttctgtgatgttgttgt

SEQ ID NO: 4878 - DNA, 19 bp, Arabidopsis thaliana
agacactggtgtggatggt

SEQ ID NO: 4879 - DNA, 18 bp, Arabidopsis thaliana
tgcaggagcagcagctcc

SEQ ID NO: 4880 - DNA, 18 bp, Arabidopsis thaliana
ctctctctcctattgtgt

SEQ ID NO: 4881 - DNA, 18 bp, Arabidopsis thaliana
ctatggttttgtattgaa

SEQ ID NO: 4882 - DNA, 18 bp, Arabidopsis thaliana
cagtactcaccttgttgt

SEQ ID NO: 4883 - DNA, 20 bp, Arabidopsis thaliana
aaactgctgttgctgttgct

SEQ ID NO: 4884 - DNA, 21 bp, Arabidopsis thaliana
gatgtctttgtttgttcatct

SEQ ID NO: 4885 - DNA, 18 bp, Arabidopsis thaliana
ggaatgtgtgaaaggaga

SEQ ID NO: 4886 - DNA, 20 bp, Arabidopsis thaliana
agggtttgttgttgctgctt

SEQ ID NO: 4887 - DNA, 18 bp, Arabidopsis thaliana
tgtggatgtctttgcatg

SEQ ID NO: 4888 - DNA, 19 bp, Arabidopsis thaliana
taagaacatgattgagagt

SEQ ID NO: 4889 - DNA, 22 bp, Arabidopsis thaliana
ctgcttctgctgctgcagctct

SEQ ID NO: 4890 - DNA, 21 bp, Arabidopsis thaliana
ttttcttctactacatgctct

SEQ ID NO: 4891 - DNA, 20 bp, Arabidopsis thaliana
tgatgatcatcttcttcctg

SEQ ID NO: 4892 - DNA, 21 bp, Arabidopsis thaliana
tgtgcaaatgttttgtctgtc

SEQ ID NO: 4893 - DNA, 18 bp, Arabidopsis thaliana
aatttggtgattcatcaa

SEQ ID NO: 4894 - DNA, 19 bp, Arabidopsis thaliana
ttgactcttcttcttctgt

SEQ ID NO: 4895 - DNA, 23 bp, Arabidopsis thaliana
tgtgtgagtgtgtgtctgtgttt

SEQ ID NO: 4896 - DNA, 19 bp, Arabidopsis thaliana
agatagattgatgtttgag

SEQ ID NO: 4897 - DNA, 20 bp, Arabidopsis thaliana
attctgatgttgctgtgact

SEQ ID NO: 4898 - DNA, 21 bp, Arabidopsis thaliana
agaaatctgatgaagctgcaa

SEQ ID NO: 4899 - DNA, 23 bp, Arabidopsis thaliana
agactcgtcttcttcttcatcat

SEQ ID NO: 4900 - DNA, 22 bp, Arabidopsis thaliana
attgtcttgttcttcatgtgtg

SEQ ID NO: 4901 - DNA, 21 bp, Arabidopsis thaliana
cgatcgatccctccctgggag

SEQ ID NO: 4902 - DNA, 18 bp, Arabidopsis thaliana
gtgtcaacttcctgtgtc

SEQ ID NO: 4903 - DNA, 19 bp, Arabidopsis thaliana
tcagactccaaatgatctt

SEQ ID NO: 4904 - DNA, 22 bp, Arabidopsis thaliana
agaaacttcttcttcttcaaca

SEQ ID NO: 4905 - DNA, 22 bp, Arabidopsis thaliana
ttgtgatgttgctgagttgtgt

SEQ ID NO: 4906 - DNA, 23 bp, Arabidopsis thaliana
tgtgatgttgctgagttgtgtag

SEQ ID NO: 4907 - DNA, 23 bp, Arabidopsis thaliana
ctgctgatgttgttgatcatctt

SEQ ID NO: 4908 - DNA, 23 bp, Arabidopsis thaliana
cttggttgttgatgatgatgggt

SEQ ID NO: 4909 - DNA, 18 bp, Arabidopsis thaliana
ttgttgttgatgtagctg

SEQ ID NO: 4910 - DNA, 19 bp, Arabidopsis thaliana
tcaacattgtggttgctgt

SEQ ID NO: 4911 - DNA, 20 bp, Arabidopsis thaliana
aatgtgctctttgttggttc

SEQ ID NO: 4912 - DNA, 21 bp, Arabidopsis thaliana
tgagtttgttatatgatgtga

SEQ ID NO: 4913 - DNA, 21 bp, Arabidopsis thaliana
tcttgtgttgtagctgtgtgt

SEQ ID NO: 4914 - DNA, 19 bp, Arabidopsis thaliana
tatgagctagtttcatgat

SEQ ID NO: 4915 - DNA, 22 bp, Arabidopsis thaliana
tgaggaacttgtgtgtgctttt

SEQ ID NO: 4916 - DNA, 21 bp, Arabidopsis thaliana
ctttggtgttttcaggtgtat

SEQ ID NO: 4917 - DNA, 23 bp, Arabidopsis thaliana
ttctctgtctccgagtcatgact

SEQ ID NO: 4918 - DNA, 20 bp, Arabidopsis thaliana
tgagctagtttctttgaatc

SEQ ID NO: 4919 - DNA, 18 bp, Arabidopsis thaliana
tacagtgaggtttacaag

SEQ ID NO: 4920 - DNA, 20 bp, Arabidopsis thaliana
agagagatagcattctatgt

SEQ ID NO: 4921 - DNA, 23 bp, Arabidopsis thaliana
atcattgacattgttgttgttgt

SEQ ID NO: 4922 - DNA, 19 bp, Arabidopsis thaliana
aaagttgttgggttttgag

SEQ ID NO: 4923 - DNA, 18 bp, Arabidopsis thaliana
gtagttgttggtggtgca

SEQ ID NO: 4924 - DNA, 20 bp, Arabidopsis thaliana
gctctgataccatatagagg

SEQ ID NO: 4925 - DNA, 19 bp, Arabidopsis thaliana
ttgtttgtctggaagtcca

SEQ ID NO: 4926 - DNA, 20 bp, Arabidopsis thaliana
atcttgttctggttctgagt

SEQ ID NO: 4927 - DNA, 20 bp, Arabidopsis thaliana
ttgtcagttattcttggttt

SEQ ID NO: 4928 - DNA, 19 bp, Arabidopsis thaliana
tttcatgtgattttgttga

SEQ ID NO: 4929 - DNA, 19 bp, Arabidopsis thaliana
gtggaggtgctgctggtgc

SEQ ID NO: 4930 - DNA, 21 bp, Arabidopsis thaliana
ttggctttgagtttctttgct

SEQ ID NO: 4931 - DNA, 18 bp, Arabidopsis thaliana
gaggatgatctaagtgga

SEQ ID NO: 4932 - DNA, 23 bp, Arabidopsis thaliana
tgctctgataccaaatgatagat

SEQ ID NO: 4933 - DNA, 23 bp, Arabidopsis thaliana
tgctctgataccaaatgatagat

SEQ ID NO: 4934 - DNA, 19 bp, Arabidopsis thaliana
tctgtttccaaatgaatgg

SEQ ID NO: 4935 - DNA, 19 bp, Arabidopsis thaliana
gagtgagattggttcttgt

SEQ ID NO: 4936 - DNA, 21 bp, Arabidopsis thaliana
tgtctcaggttctttcttctt

SEQ ID NO: 4937 - DNA, 22 bp, Arabidopsis thaliana
atcacacaaaggcaactcttga

SEQ ID NO: 4938 - DNA, 23 bp, Arabidopsis thaliana
tgaattggattctgaggatgatg

SEQ ID NO: 4939 - DNA, 20 bp, Arabidopsis thaliana
gaatgtgtttgttgattgat

SEQ ID NO: 4940 - DNA, 21 bp, Arabidopsis thaliana
ttagatgaccatcaacaaact

SEQ ID NO: 4941 - DNA, 19 bp, Arabidopsis thaliana
ttgcagatgatggtggtag

SEQ ID NO: 4942 - DNA, 23 bp, Arabidopsis thaliana
acgtacattgatgttgaagatgt

SEQ ID NO: 4943 - DNA, 21 bp, Arabidopsis thaliana
tagccattggtgttgttgctt

SEQ ID NO: 4944 - DNA, 22 bp, Arabidopsis thaliana
gttgtttctctgaggatgagac

SEQ ID NO: 4945 - DNA, 20 bp, Arabidopsis thaliana
acaatgtggttttgatcatt

SEQ ID NO: 4946 - DNA, 21 bp, Arabidopsis thaliana
tagccaaggatgacttgcctg

SEQ ID NO: 4947 - DNA, 21 bp, Arabidopsis thaliana
tagccaaggatgacttgcctg

SEQ ID NO: 4948 - DNA, 21 bp, Arabidopsis thaliana
tagccaaggatgacttgcctg

SEQ ID NO: 4949 - DNA, 21 bp, Arabidopsis thaliana
tactgcaagatgtttgcatgt

SEQ ID NO: 4950 - DNA, 23 bp, Arabidopsis thaliana
tgagtatgcacatgttcttcttc

SEQ ID NO: 4951 - DNA, 19 bp, Arabidopsis thaliana
tgcagatgatgatgatgat

SEQ ID NO: 4952 - DNA, 21 bp, Arabidopsis thaliana
agtgcttgcccatgtgtgtgt

SEQ ID NO: 4953 - DNA, 19 bp, Arabidopsis thaliana
tgtggttcttgtttcatga

SEQ ID NO: 4954 - DNA, 22 bp, Arabidopsis thaliana
gcttcattgagttgtttgattt

SEQ ID NO: 4955 - DNA, 20 bp, Arabidopsis thaliana
ttccctgagctattgatgtg

SEQ ID NO: 4956 - DNA, 22 bp, Arabidopsis thaliana
attgtgatcattgtcatggtca

SEQ ID NO: 4957 - DNA, 22 bp, Arabidopsis thaliana
tatggtcatggtcatcgtgagc

SEQ ID NO: 4958 - DNA, 23 bp, Arabidopsis thaliana
ggtcatcatcatcatcgtggtca

SEQ ID NO: 4959 - DNA, 23 bp, Arabidopsis thaliana
tcatggtcatggtcgtggtcgtg

SEQ ID NO: 4960 - DNA, 18 bp, Arabidopsis thaliana
tcaactacttcatacaca

SEQ ID NO: 4961 - DNA, 21 bp, Arabidopsis thaliana
aaagtgccaatgtacatgaac

SEQ ID NO: 4962 - DNA, 19 bp, Arabidopsis thaliana
acatgaagaagaatatgtt

SEQ ID NO: 4963 - DNA, 23 bp, Arabidopsis thaliana
catgagaatgttgatgttgctca

SEQ ID NO: 4964 - DNA, 21 bp, Arabidopsis thaliana
agactctcaccataactcttg

SEQ ID NO: 4965 - DNA, 20 bp, Arabidopsis thaliana
cacagatgatgatgatgaag

SEQ ID NO: 4966 - DNA, 22 bp, Arabidopsis thaliana
aagctggaagagaagcagcaga

SEQ ID NO: 4967 - DNA, 19 bp, Arabidopsis thaliana
tgtgtatacagtgtgatgt

SEQ ID NO: 4968 - DNA, 22 bp, Arabidopsis thaliana
agtattgaagatgttgaagatg

SEQ ID NO: 4969 - DNA, 20 bp, Arabidopsis thaliana
agctgcactagatcctggtg

SEQ ID NO: 4970 - DNA, 21 bp, Arabidopsis thaliana
acagtagtatgatgtgttgat

SEQ ID NO: 4971 - DNA, 20 bp, Arabidopsis thaliana
tgaagagtttggaggaactc

SEQ ID NO: 4972 - DNA, 19 bp, Arabidopsis thaliana
tgtgttcttgttgaaatct

SEQ ID NO: 4973 - DNA, 20 bp, Arabidopsis thaliana
tggcacaatctggctttgct

SEQ ID NO: 4974 - DNA, 20 bp, Arabidopsis thaliana
agatacttgcagaagcactt

SEQ ID NO: 4975 - DNA, 18 bp, Arabidopsis thaliana
tgagtattgcatctgctt

SEQ ID NO: 4976 - DNA, 22 bp, Arabidopsis thaliana
ctagtgctgctgctgctgcttc

SEQ ID NO: 4977 - DNA, 23 bp, Arabidopsis thaliana
gtttctcactacttttctttggg

SEQ ID NO: 4978 - DNA, 21 bp, Arabidopsis thaliana
tcactgaagagagacaggata

SEQ ID NO: 4979 - DNA, 19 bp, Arabidopsis thaliana
gacaacttagcagatacag

SEQ ID NO: 4980 - DNA, 21 bp, Arabidopsis thaliana
atcacagccattttgatgtga

SEQ ID NO: 4981 - DNA, 19 bp, Arabidopsis thaliana
aagtgtctgcaaaagtaga

SEQ ID NO: 4982 - DNA, 23 bp, Arabidopsis thaliana
tatgtgtatgtggttgtgaatgt

SEQ ID NO: 4983 - DNA, 21 bp, Arabidopsis thaliana
ttgtgtatgtgtatgtgtatg

SEQ ID NO: 4984 - DNA, 20 bp, Arabidopsis thaliana
atacaggctggttctgaagt

SEQ ID NO: 4985 - DNA, 23 bp, Arabidopsis thaliana
gtgaagatcgaattgtgagtcct

SEQ ID NO: 4986 - DNA, 20 bp, Arabidopsis thaliana
aagatgaagaagatgatgtt

SEQ ID NO: 4987 - DNA, 23 bp, Arabidopsis thaliana
ttcttgacatgttttgttctttt

SEQ ID NO: 4988 - DNA, 19 bp, Arabidopsis thaliana
agacatcatttagaaatct

SEQ ID NO: 4989 - DNA, 18 bp, Arabidopsis thaliana
gtcttggtggaggaggcg

SEQ ID NO: 4990 - DNA, 22 bp, Arabidopsis thaliana
ctttggactacagagagagaga

SEQ ID NO: 4991 - DNA, 22 bp, Arabidopsis thaliana
atgatcatgatcatgatggtga

SEQ ID NO: 4992 - DNA, 21 bp, Arabidopsis thaliana
tgagagagagagagagagact

SEQ ID NO: 4993 - DNA, 19 bp, Arabidopsis thaliana
tgatgatgctggtgcattg

SEQ ID NO: 4994 - DNA, 19 bp, Arabidopsis thaliana
ttcagatgttggtggatga

SEQ ID NO: 4995 - DNA, 20 bp, Arabidopsis thaliana
tttcttgttgtagctccaat

SEQ ID NO: 4996 - DNA, 18 bp, Arabidopsis thaliana
tcttgtctgtgtttgact

SEQ ID NO: 4997 - DNA, 18 bp, Arabidopsis thaliana
agattcttccttttgctg

SEQ ID NO: 4998 - DNA, 18 bp, Arabidopsis thaliana
tttggtattgttggttct

SEQ ID NO: 4999 - DNA, 20 bp, Arabidopsis thaliana
tgtgcttgaatcttgattat

SEQ ID NO: 5000 - DNA, 23 bp, Arabidopsis thaliana
atttgtgtatgtatgtacatgtg

SEQ ID NO: 5001 - DNA, 19 bp, Arabidopsis thaliana
tactgatgttgctgctcgt

SEQ ID NO: 5002 - DNA, 18 bp, Arabidopsis thaliana
tccgtctccataactttt

SEQ ID NO: 5003 - DNA, 19 bp, Arabidopsis thaliana
tggattcttgatatagttg

SEQ ID NO: 5004 - DNA, 21 bp, Arabidopsis thaliana
acttgtattgttgccttgttt

SEQ ID NO: 5005 - DNA, 23 bp, Arabidopsis thaliana
ttcgtcatcgtcatcatcgtcat

SEQ ID NO: 5006 - DNA, 21 bp, Arabidopsis thaliana
agcttgctgtgctggtacttg

SEQ ID NO: 5007 - DNA, 21 bp, Arabidopsis thaliana
agagagagcgtgagagagagt

SEQ ID NO: 5008 - DNA, 19 bp, Arabidopsis thaliana
agtctcatcttcttcgtca

SEQ ID NO: 5009 - DNA, 18 bp, Arabidopsis thaliana
actcatcgatgacttgaa

SEQ ID NO: 5010 - DNA, 20 bp, Arabidopsis thaliana
agtgttaagatgttgatctt

SEQ ID NO: 5011 - DNA, 23 bp, Arabidopsis thaliana
aaagcagaggttgatcttgattc

SEQ ID NO: 5012 - DNA, 21 bp, Arabidopsis thaliana
atcaatgaagaagatgaagat

SEQ ID NO: 5013 - DNA, 19 bp, Arabidopsis thaliana
atcgtcgtcgtcatcttca

SEQ ID NO: 5014 - DNA, 20 bp, Arabidopsis thaliana
ttggtttgtgtccatctgca

SEQ ID NO: 5015 - DNA, 21 bp, Arabidopsis thaliana
ttatgtcttcttcttcttcaa

SEQ ID NO: 5016 - DNA, 18 bp, Arabidopsis thaliana
ggctgtgctgtgtgttga

SEQ ID NO: 5017 - DNA, 18 bp, Arabidopsis thaliana
gagcattgttcaagctgt

SEQ ID NO: 5018 - DNA, 20 bp, Arabidopsis thaliana
agtgactggtttagcattct

SEQ ID NO: 5019 - DNA, 23 bp, Arabidopsis thaliana
ctgtagagttctgatgatgatga

SEQ ID NO: 5020 - DNA, 21 bp, Arabidopsis thaliana
agctgaagctggaggtgatca

SEQ ID NO: 5021 - DNA, 19 bp, Arabidopsis thaliana
tctctcgatctctcgcgtt

SEQ ID NO: 5022 - DNA, 23 bp, Arabidopsis thaliana
tactactagaagaagatgatgat

SEQ ID NO: 5023 - DNA, 18 bp, Arabidopsis thaliana
gaatctggtaatgtttgc

SEQ ID NO: 5024 - DNA, 20 bp, Arabidopsis thaliana
taacacttgttgatctgatt

SEQ ID NO: 5025 - DNA, 22 bp, Arabidopsis thaliana
gagtcgaggagatggagactga

SEQ ID NO: 5026 - DNA, 19 bp, Arabidopsis thaliana
actctgttttcgattgatg

SEQ ID NO: 5027 - DNA, 23 bp, Arabidopsis thaliana
tgatgatgatgatgatgatgtag

SEQ ID NO: 5028 - DNA, 20 bp, Arabidopsis thaliana
tttgatgctgatggtgtgat

SEQ ID NO: 5029 - DNA, 20 bp, Arabidopsis thaliana
acagcaacagcagcagcagc

SEQ ID NO: 5030 - DNA, 18 bp, Arabidopsis thaliana
ttgaaggtgttgattgga

SEQ ID NO: 5031 - DNA, 23 bp, Arabidopsis thaliana
tcatgatgatgatcatgatcatg

SEQ ID NO: 5032 - DNA, 22 bp, Arabidopsis thaliana
acagcagctggagcagctgctc

SEQ ID NO: 5033 - DNA, 22 bp, Arabidopsis thaliana
tctatgtgattgttgattgatt

SEQ ID NO: 5034 - DNA, 19 bp, Arabidopsis thaliana
tgttttcttttgttgctat

SEQ ID NO: 5035 - DNA, 19 bp, Arabidopsis thaliana
gcagcacttgatgctcctg

SEQ ID NO: 5036 - DNA, 19 bp, Arabidopsis thaliana
tcttgatgatgatgttgat

SEQ ID NO: 5037 - DNA, 23 bp, Arabidopsis thaliana
ccttttgttcattgtggaagtag

SEQ ID NO: 5038 - DNA, 20 bp, Arabidopsis thaliana
ttgtctttagtttttgttgt

SEQ ID NO: 5039 - DNA, 21 bp, Arabidopsis thaliana
tgggtggtgatcatataagat

SEQ ID NO: 5040 - DNA, 21 bp, Arabidopsis thaliana
gtcatgaacgtgaatggactt

SEQ ID NO: 5041 - DNA, 21 bp, Arabidopsis thaliana
aagtgcttgctttttcatgtt

SEQ ID NO: 5042 - DNA, 20 bp, Arabidopsis thaliana
ttatgtgtgttaatctagct

SEQ ID NO: 5043 - DNA, 18 bp, Arabidopsis thaliana
atcacaggcaggcttgga

SEQ ID NO: 5044 - DNA, 21 bp, Arabidopsis thaliana
tctttgttattattcgttgtt

SEQ ID NO: 5045 - DNA, 18 bp, Arabidopsis thaliana
tgctttgcttcctgcatg

SEQ ID NO: 5046 - DNA, 19 bp, Arabidopsis thaliana
aggtacattggtgtgggtg

SEQ ID NO: 5047 - DNA, 20 bp, Arabidopsis thaliana
ttcaggttgttgtatgtatg

SEQ ID NO: 5048 - DNA, 18 bp, Arabidopsis thaliana
tatgtctagttttgttgg

SEQ ID NO: 5049 - DNA, 21 bp, Arabidopsis thaliana
tcgctgtgagtttgacttgat

SEQ ID NO: 5050 - DNA, 20 bp, Arabidopsis thaliana
actgacattgggatggtggt

SEQ ID NO: 5051 - DNA, 21 bp, Arabidopsis thaliana
acagtcttcttcttcttctcg

SEQ ID NO: 5052 - DNA, 23 bp, Arabidopsis thaliana
tgagaatcttgatgatgctgcag

SEQ ID NO: 5053 - DNA, 20 bp, Arabidopsis thaliana
atgctctgtttcttgttcct

SEQ ID NO: 5054 - DNA, 18 bp, Arabidopsis thaliana
tttgtgatgatgatggag

SEQ ID NO: 5055 - DNA, 23 bp, Arabidopsis thaliana
ttgatgatgatgatgatgatgat

SEQ ID NO: 5056 - DNA, 19 bp, Arabidopsis thaliana
cccaaatgtagacaaagca

SEQ ID NO: 5057 - DNA, 23 bp, Arabidopsis thaliana
caggtgagtctctgtctctctgt

SEQ ID NO: 5058 - DNA, 22 bp, Arabidopsis thaliana
caagatcttcttgttggtgtgg

SEQ ID NO: 5059 - DNA, 21 bp, Arabidopsis thaliana
gtgtgtcctcatcttcttcat

SEQ ID NO: 5060 - DNA, 21 bp, Arabidopsis thaliana
tacgcattgttgttgttgtta

SEQ ID NO: 5061 - DNA, 21 bp, Arabidopsis thaliana
tgagcttcttttttgcaggag

SEQ ID NO: 5062 - DNA, 21 bp, Arabidopsis thaliana
attgctttagttatgacattg

SEQ ID NO: 5063 - DNA, 19 bp, Arabidopsis thaliana
tgagactgagagatcctga

SEQ ID NO: 5064 - DNA, 18 bp, Arabidopsis thaliana
gcgccgccgccggtgcac

SEQ ID NO: 5065 - DNA, 23 bp, Arabidopsis thaliana
tcgtcgtcgtcttcttcttcgtc

SEQ ID NO: 5066 - DNA, 20 bp, Arabidopsis thaliana
tctctctccttatcttacag

SEQ ID NO: 5067 - DNA, 18 bp, Arabidopsis thaliana
ggcggcgccgcggcggag

SEQ ID NO: 5068 - DNA, 23 bp, Arabidopsis thaliana
gtgttgtttgatattcttcttca

SEQ ID NO: 5069 - DNA, 20 bp, Arabidopsis thaliana
aggtagtatattgtattatt

SEQ ID NO: 5070 - DNA, 21 bp, Arabidopsis thaliana
tgtgattactgatcttgtaga

SEQ ID NO: 5071 - DNA, 19 bp, Arabidopsis thaliana
tcatggtcatcgtcatcga

SEQ ID NO: 5072 - DNA, 21 bp, Arabidopsis thaliana
ttcttgagtgttgatgtcttt

SEQ ID NO: 5073 - DNA, 20 bp, Arabidopsis thaliana
tgagcaagtaatttgtgtga

SEQ ID NO: 5074 - DNA, 23 bp, Arabidopsis thaliana
tcatcatcatcatcatcttcgtc

SEQ ID NO: 5075 - DNA, 23 bp, Arabidopsis thaliana
tagaagaagacgaagaattgttg

SEQ ID NO: 5076 - DNA, 23 bp, Arabidopsis thaliana
acatgagtcttcttctacatctc

SEQ ID NO: 5077 - DNA, 18 bp, Arabidopsis thaliana
aagattgattttgttgga

SEQ ID NO: 5078 - DNA, 22 bp, Arabidopsis thaliana
agttctgagttgttgttgatta

SEQ ID NO: 5079 - DNA, 20 bp, Arabidopsis thaliana
ttttgaattgaatttgttga

SEQ ID NO: 5080 - DNA, 19 bp, Arabidopsis thaliana
atttgtctgatgttgttga

SEQ ID NO: 5081 - DNA, 18 bp, Arabidopsis thaliana
tgagcatccttctctctc

SEQ ID NO: 5082 - DNA, 20 bp, Arabidopsis thaliana
tgtcccatgttgttgttgtt

SEQ ID NO: 5083 - DNA, 21 bp, Arabidopsis thaliana
atcagtttcttgatcgtttct

SEQ ID NO: 5084 - DNA, 23 bp, Arabidopsis thaliana
taagtgtgtgtgtgtgtacttcc

SEQ ID NO: 5085 - DNA, 22 bp, Arabidopsis thaliana
ataagtcagaggttctttaagt

SEQ ID NO: 5086 - DNA, 23 bp, Arabidopsis thaliana
tgtatgtgttctcttgttgttct

SEQ ID NO: 5087 - DNA, 19 bp, Arabidopsis thaliana
gagaagagagagacttgtc

SEQ ID NO: 5088 - DNA, 18 bp, Arabidopsis thaliana
tggcaagttgttcacttt

SEQ ID NO: 5089 - DNA, 20 bp, Arabidopsis thaliana
tcgctgctttagatgtatgt

SEQ ID NO: 5090 - DNA, 20 bp, Arabidopsis thaliana
tgcttcttgttcatcctgca

SEQ ID NO: 5091 - DNA, 22 bp, Arabidopsis thaliana
tcaatttcatgatgatcatgat

SEQ ID NO: 5092 - DNA, 20 bp, Arabidopsis thaliana
ttggtaggatttgttcacta

SEQ ID NO: 5093 - DNA, 22 bp, Arabidopsis thaliana
ttgattgtgtgcaagtatacat

SEQ ID NO: 5094 - DNA, 18 bp, Arabidopsis thaliana
atgacagctaaagctgat

SEQ ID NO: 5095 - DNA, 19 bp, Arabidopsis thaliana
ttgtgtgtgtgtttcacca

SEQ ID NO: 5096 - DNA, 18 bp, Arabidopsis thaliana
agatcaagatccttgaag

SEQ ID NO: 5097 - DNA, 18 bp, Arabidopsis thaliana
tcaatgtcaaggtcctct

SEQ ID NO: 5098 - DNA, 19 bp, Arabidopsis thaliana
tggagtagctgctgctctc

SEQ ID NO: 5099 - DNA, 18 bp, Arabidopsis thaliana
agtttcatcatgatcatg

SEQ ID NO: 5100 - DNA, 19 bp, Arabidopsis thaliana
tcttcatcatcatctgagt

SEQ ID NO: 5101 - DNA, 21 bp, Arabidopsis thaliana
ctctagtgttgatgatgtttg

SEQ ID NO: 5102 - DNA, 20 bp, Arabidopsis thaliana
acacaagtgatgttgttgat

SEQ ID NO: 5103 - DNA, 18 bp, Arabidopsis thaliana
tcgctgaagttgggattg

SEQ ID NO: 5104 - DNA, 18 bp, Arabidopsis thaliana
ttcagctgcagcatctag

SEQ ID NO: 5105 - DNA, 23 bp, Arabidopsis thaliana
ctggtgctgctgctgctcctgag

SEQ ID NO: 5106 - DNA, 22 bp, Arabidopsis thaliana
atgttggtgatgatgagcatga

SEQ ID NO: 5107 - DNA, 18 bp, Arabidopsis thaliana
ttctctacttcttgttct

SEQ ID NO: 5108 - DNA, 20 bp, Arabidopsis thaliana
tatgtgtgtgtacatgcatg

SEQ ID NO: 5109 - DNA, 22 bp, Arabidopsis thaliana
tgtgatgactgatgagttagta

SEQ ID NO: 5110 - DNA, 23 bp, Arabidopsis thaliana
atgaagaagatgacgaagaactt

SEQ ID NO: 5111 - DNA, 18 bp, Arabidopsis thaliana
atggtggtgatgctgctg

SEQ ID NO: 5112 - DNA, 22 bp, Arabidopsis thaliana
tcagggtgttggttctatggtt

SEQ ID NO: 5113 - DNA, 19 bp, Arabidopsis thaliana
caagtttattgagtcagaa

SEQ ID NO: 5114 - DNA, 18 bp, Arabidopsis thaliana
ttactatcatgcacacat

SEQ ID NO: 5115 - DNA, 22 bp, Arabidopsis thaliana
atctcattgttgtagttgtttc

SEQ ID NO: 5116 - DNA, 21 bp, Arabidopsis thaliana
aaatgtcattttgtaaagcag

SEQ ID NO: 5117 - DNA, 20 bp, Arabidopsis thaliana
gtttgtgttctatgttgctt

SEQ ID NO: 5118 - DNA, 22 bp, Arabidopsis thaliana
tgtttctgtgtggtagtgaaga

SEQ ID NO: 5119 - DNA, 19 bp, Arabidopsis thaliana
ttctttgttgttggagttg

SEQ ID NO: 5120 - DNA, 23 bp, Arabidopsis thaliana
acgtctggctctcctgctgcagc

SEQ ID NO: 5121 - DNA, 20 bp, Arabidopsis thaliana
atgttgcagaatcttttgct

SEQ ID NO: 5122 - DNA, 20 bp, Arabidopsis thaliana
tctgcttgatgaagtaactg

SEQ ID NO: 5123 - DNA, 20 bp, Arabidopsis thaliana
cctgcagctgctgcagcacg

SEQ ID NO: 5124 - DNA, 18 bp, Arabidopsis thaliana
ttacgtatgtacctcaat

SEQ ID NO: 5125 - DNA, 19 bp, Arabidopsis thaliana
atgtgtgtatgtatgtata

SEQ ID NO: 5126 - DNA, 18 bp, Arabidopsis thaliana
tgtgcttctctttgaagg

SEQ ID NO: 5127 - DNA, 21 bp, Arabidopsis thaliana
aagagtcctggtcctgttcag

SEQ ID NO: 5128 - DNA, 18 bp, Arabidopsis thaliana
cgcaggtgttgcttttgc

SEQ ID NO: 5129 - DNA, 22 bp, Arabidopsis thaliana
tgttactggttctgcatggttt

SEQ ID NO: 5130 - DNA, 19 bp, Arabidopsis thaliana
tgaaggagtttgttgttgt

SEQ ID NO: 5131 - DNA, 20 bp, Arabidopsis thaliana
atgacggtgaagatgttgtt

SEQ ID NO: 5132 - DNA, 20 bp, Arabidopsis thaliana
atgagtgtgttagtgtgtgt

SEQ ID NO: 5133 - DNA, 21 bp, Arabidopsis thaliana
aagtgattgtgattgtgtgtg

SEQ ID NO: 5134 - DNA, 20 bp, Arabidopsis thaliana
tgtgtctgagaatctgagtg

SEQ ID NO: 5135 - DNA, 20 bp, Arabidopsis thaliana
tgagatacttgcttcttctg

SEQ ID NO: 5136 - DNA, 23 bp, Arabidopsis thaliana
ttgagtgatcttgatgttgttca

SEQ ID NO: 5137 - DNA, 23 bp, Arabidopsis thaliana
tgtgtgtgcgtgtgtgtgactga

SEQ ID NO: 5138 - DNA, 21 bp, Arabidopsis thaliana
tctcggttcgcgatccacaag

SEQ ID NO: 5139 - DNA, 21 bp, Arabidopsis thaliana
tgggtggcaaacaaagacgac

SEQ ID NO: 5140 - DNA, 18 bp, Arabidopsis thaliana
atgtcactgtacatatag

SEQ ID NO: 5141 - DNA, 21 bp, Arabidopsis thaliana
tcagagcctttttggttgtgt

SEQ ID NO: 5142 - DNA, 19 bp, Arabidopsis thaliana
ctgccgctgctgctgctcg

SEQ ID NO: 5143 - DNA, 20 bp, Arabidopsis thaliana
ttattgatgatgatgcacgt

SEQ ID NO: 5144 - DNA, 21 bp, Arabidopsis thaliana
taagtgcgtctatgttgtggt

SEQ ID NO: 5145 - DNA, 18 bp, Arabidopsis thaliana
ttcagcagcagcttgagc

SEQ ID NO: 5146 - DNA, 19 bp, Arabidopsis thaliana
tctgctctgttgctcctca

SEQ ID NO: 5147 - DNA, 20 bp, Arabidopsis thaliana
tgtgtttgtgttacagtttc

SEQ ID NO: 5148 - DNA, 19 bp, Arabidopsis thaliana
agtcttagcttgttatggt

SEQ ID NO: 5149 - DNA, 19 bp, Arabidopsis thaliana
tcagtatccatcttgttga

SEQ ID NO: 5150 - DNA, 21 bp, Arabidopsis thaliana
tatgtgtttccatgttctagt

SEQ ID NO: 5151 - DNA, 20 bp, Arabidopsis thaliana
aacacatctcatattgtaca

SEQ ID NO: 5152 - DNA, 18 bp, Arabidopsis thaliana
tgattgtgtgcatgttag

SEQ ID NO: 5153 - DNA, 21 bp, Arabidopsis thaliana
cttctgtatgcatcttcagct

SEQ ID NO: 5154 - DNA, 20 bp, Arabidopsis thaliana
tgatctcttgctgattgtgg

SEQ ID NO: 5155 - DNA, 23 bp, Arabidopsis thaliana
tgattcagaatggagttagtgta

SEQ ID NO: 5156 - DNA, 19 bp, Arabidopsis thaliana
gctggtggtggcagtgctg

SEQ ID NO: 5157 - DNA, 18 bp, Arabidopsis thaliana
ttgaaagtacttggtgtg

SEQ ID NO: 5158 - DNA, 23 bp, Arabidopsis thaliana
gatagattcatgttgttggtgga

SEQ ID NO: 5159 - DNA, 23 bp, Arabidopsis thaliana
atagagtctgtgtcactgtgtga

SEQ ID NO: 5160 - DNA, 23 bp, Arabidopsis thaliana
tatctgtggttgtggatgagtga

SEQ ID NO: 5161 - DNA, 21 bp, Arabidopsis thaliana
tcatctccattagttttgatg

SEQ ID NO: 5162 - DNA, 21 bp, Arabidopsis thaliana
tctttgatgatgatgatggat

SEQ ID NO: 5163 - DNA, 23 bp, Arabidopsis thaliana
cagctcttgcagctgctgcagca

SEQ ID NO: 5164 - DNA, 21 bp, Arabidopsis thaliana
tttggattgttgttgctcttg

SEQ ID NO: 5165 - DNA, 23 bp, Arabidopsis thaliana
gtctcacgatgtgtctgtgtctg

SEQ ID NO: 5166 - DNA, 23 bp, Arabidopsis thaliana
tgctcagaagcttgaggaagcta

SEQ ID NO: 5167 - DNA, 19 bp, Arabidopsis thaliana
tgagtcttgaagctgctgc

SEQ ID NO: 5168 - DNA, 23 bp, Arabidopsis thaliana
tcatcatcctcttcttcatcgtc

SEQ ID NO: 5169 - DNA, 19 bp, Arabidopsis thaliana
cctctgtttcattttgttg

SEQ ID NO: 5170 - DNA, 20 bp, Arabidopsis thaliana
ttgagattgttgttgctgag

SEQ ID NO: 5171 - DNA, 21 bp, Arabidopsis thaliana
accattggttttgatgatgga

SEQ ID NO: 5172 - DNA, 21 bp, Arabidopsis thaliana
atgtgtgtttatatctacttg

SEQ ID NO: 5173 - DNA, 23 bp, Arabidopsis thaliana
catcatcatcatcatcaagctct

SEQ ID NO: 5174 - DNA, 19 bp, Arabidopsis thaliana
atgactcagattatgatgt

SEQ ID NO: 5175 - DNA, 21 bp, Arabidopsis thaliana
aatggaactgtgtctgtgtgt

SEQ ID NO: 5176 - DNA, 23 bp, Arabidopsis thaliana
atgtatgaatgcatgaatgcatg

SEQ ID NO: 5177 - DNA, 22 bp, Arabidopsis thaliana
atgtatgaatgcatgtatgtat

SEQ ID NO: 5178 - DNA, 20 bp, Arabidopsis thaliana
gtatgtatgtatgtatgtat

SEQ ID NO: 5179 - DNA, 20 bp, Arabidopsis thaliana
atgtatgatgtgtgtgtatg

SEQ ID NO: 5180 - DNA, 20 bp, Arabidopsis thaliana
atcatcatcatcattttcat

SEQ ID NO: 5181 - DNA, 20 bp, Arabidopsis thaliana
atcttcttcttcttcctgca

SEQ ID NO: 5182 - DNA, 21 bp, Arabidopsis thaliana
ccttggagaaatatgcgtcaa

SEQ ID NO: 5183 - DNA, 21 bp, Arabidopsis thaliana
gatggatatgtcttcaaggac

SEQ ID NO: 5184 - DNA, 18 bp, Arabidopsis thaliana
tcttcatcatcatcctca

SEQ ID NO: 5185 - DNA, 21 bp, Arabidopsis thaliana
ttcagctgcagcttcagcttc

SEQ ID NO: 5186 - DNA, 18 bp, Arabidopsis thaliana
cgctgttgttgattttgg

SEQ ID NO: 5187 - DNA, 19 bp, Arabidopsis thaliana
aatgtcatgatttgcttca

SEQ ID NO: 5188 - DNA, 18 bp, Arabidopsis thaliana
tccatatgattggtgtat

SEQ ID NO: 5189 - DNA, 18 bp, Arabidopsis thaliana
ataatgatgatgatggta

SEQ ID NO: 5190 - DNA, 23 bp, Arabidopsis thaliana
tgtctgtctgtgagtgtgtttca

SEQ ID NO: 5191 - DNA, 20 bp, Arabidopsis thaliana
agagagcatgcattgttgac

SEQ ID NO: 5192 - DNA, 21 bp, Arabidopsis thaliana
tgactctttttctctctgcaa

SEQ ID NO: 5193 - DNA, 23 bp, Arabidopsis thaliana
tgtgactcctgatgttgttgagg

SEQ ID NO: 5194 - DNA, 18 bp, Arabidopsis thaliana
tcgatgatgatgatggtg

SEQ ID NO: 5195 - DNA, 22 bp, Arabidopsis thaliana
aaagaggtacagatttgagtgt

SEQ ID NO: 5196 - DNA, 22 bp, Arabidopsis thaliana
accagtcagattttggatctgt

SEQ ID NO: 5197 - DNA, 22 bp, Arabidopsis thaliana
atttggtagtggttgatgtgac

SEQ ID NO: 5198 - DNA, 22 bp, Arabidopsis thaliana
ttcgaagtttgatcttgttggg

SEQ ID NO: 5199 - DNA, 21 bp, Arabidopsis thaliana
ttgacattgattttcttggca

SEQ ID NO: 5200 - DNA, 19 bp, Arabidopsis thaliana
tctgtcgcagagagcgtgg

SEQ ID NO: 5201 - DNA, 20 bp, Arabidopsis thaliana
ttgtgtcatgttgctgctca

SEQ ID NO: 5202 - DNA, 21 bp, Arabidopsis thaliana
actttggtcttctttgtgatg

SEQ ID NO: 5203 - DNA, 19 bp, Arabidopsis thaliana
tatgtgtgtgtgtgtatct

SEQ ID NO: 5204 - DNA, 19 bp, Arabidopsis thaliana
tttcatgtgattttgttga

SEQ ID NO: 5205 - DNA, 18 bp, Arabidopsis thaliana
aatggttatcttttcctt

SEQ ID NO: 5206 - DNA, 20 bp, Arabidopsis thaliana
acagtttgatgatgatgctt

SEQ ID NO: 5207 - DNA, 23 bp, Arabidopsis thaliana
catcatcatcatcatcatcttca

SEQ ID NO: 5208 - DNA, 20 bp, Arabidopsis thaliana
atgtagttggttatgtagtt

SEQ ID NO: 5209 - DNA, 23 bp, Arabidopsis thaliana
agtgactgtgtgtgtgatagtgt

SEQ ID NO: 5210 - DNA, 23 bp, Arabidopsis thaliana
tgatgagattgttgttcttggct

SEQ ID NO: 5211 - DNA, 23 bp, Arabidopsis thaliana
gctctcttcttcttcaatgtcca

SEQ ID NO: 5212 - DNA, 19 bp, Arabidopsis thaliana
taaagctactggatcattt

SEQ ID NO: 5213 - DNA, 23 bp, Arabidopsis thaliana
atatcactgttgttgttgatgat

SEQ ID NO: 5214 - DNA, 20 bp, Arabidopsis thaliana
tgagttgtgaatttgttcgt

SEQ ID NO: 5215 - DNA, 20 bp, Arabidopsis thaliana
agttgtgtgtgcatcttact

SEQ ID NO: 5216 - DNA, 19 bp, Arabidopsis thaliana
tagtttgtgtggacctggt

SEQ ID NO: 5217 - DNA, 18 bp, Arabidopsis thaliana
agaggtaggatttgtgag

SEQ ID NO: 5218 - DNA, 23 bp, Arabidopsis thaliana
ttatgtatgagattgttgtattt

SEQ ID NO: 5219 - DNA, 19 bp, Arabidopsis thaliana
tgcatcaaagttgcatttg

SEQ ID NO: 5220 - DNA, 23 bp, Arabidopsis thaliana
tgtccaagaagtttgtgatgttg

SEQ ID NO: 5221 - DNA, 20 bp, Arabidopsis thaliana
tatgatgatggttgtatagc

SEQ ID NO: 5222 - DNA, 21 bp, Arabidopsis thaliana
tttggtgtgtttgcaggtgct

SEQ ID NO: 5223 - DNA, 20 bp, Arabidopsis thaliana
gtgatgtggttgtcttgatg

SEQ ID NO: 5224 - DNA, 21 bp, Arabidopsis thaliana
agagaagtgttgttgttgaga

SEQ ID NO: 5225 - DNA, 18 bp, Arabidopsis thaliana
agtgtctagtttagttgt

SEQ ID NO: 5226 - DNA, 20 bp, Arabidopsis thaliana
tcacagggtctaaatgggca

SEQ ID NO: 5227 - DNA, 18 bp, Arabidopsis thaliana
tgttagcttcctgtgggt

SEQ ID NO: 5228 - DNA, 18 bp, Arabidopsis thaliana
gtgagtgtcgatcgacat

SEQ ID NO: 5229 - DNA, 20 bp, Arabidopsis thaliana
ttgttgttgatgtggtgtga

SEQ ID NO: 5230 - DNA, 21 bp, Arabidopsis thaliana
acagtcgtagtttgtagtagt

SEQ ID NO: 5231 - DNA, 22 bp, Arabidopsis thaliana
gtgagatgatctgaatctcttc

SEQ ID NO: 5232 - DNA, 22 bp, Arabidopsis thaliana
ggttctgctgctgctgctgagg

SEQ ID NO: 5233 - DNA, 18 bp, Arabidopsis thaliana
tgtgcaaaccgaggtggt

SEQ ID NO: 5234 - DNA, 20 bp, Arabidopsis thaliana
aacaggccgtagtgggtaga

SEQ ID NO: 5235 - DNA, 22 bp, Arabidopsis thaliana
tggaactgagtggatatgctgt

SEQ ID NO: 5236 - DNA, 19 bp, Arabidopsis thaliana
agtctttggctttgtgtct

SEQ ID NO: 5237 - DNA, 21 bp, Arabidopsis thaliana
agttgaacatgtttctgctgt

SEQ ID NO: 5238 - DNA, 22 bp, Arabidopsis thaliana
attgtgtgtgtctaagtttata

SEQ ID NO: 5239 - DNA, 19 bp, Arabidopsis thaliana
tgtgatggttttgaaatga

SEQ ID NO: 5240 - DNA, 23 bp, Arabidopsis thaliana
tttgtgagtgtgacagagagaga

SEQ ID NO: 5241 - DNA, 20 bp, Arabidopsis thaliana
atgtcttcttcttctttgtc

SEQ ID NO: 5242 - DNA, 23 bp, Arabidopsis thaliana
tgaaaggtggtgttgctggtgga

SEQ ID NO: 5243 - DNA, 19 bp, Arabidopsis thaliana
tgattggttttgtttggga

SEQ ID NO: 5244 - DNA, 22 bp, Arabidopsis thaliana
tgtttggttatctacgattttc

SEQ ID NO: 5245 - DNA, 18 bp, Arabidopsis thaliana
gtgatgatatatatgtgt

SEQ ID NO: 5246 - DNA, 23 bp, Arabidopsis thaliana
tgttcttcatcatcatcttcgtc

SEQ ID NO: 5247 - DNA, 21 bp, Arabidopsis thaliana
tggatcgtgtatgtgtgtgca

SEQ ID NO: 5248 - DNA, 20 bp, Arabidopsis thaliana
tctgcaatgatggtgatgat

SEQ ID NO: 5249 - DNA, 19 bp, Arabidopsis thaliana
ttgagaatgatgattgctt

SEQ ID NO: 5250 - DNA, 20 bp, Arabidopsis thaliana
gtttcatgatgatggtgaac

SEQ ID NO: 5251 - DNA, 18 bp, Arabidopsis thaliana
ggtcatgtctctggtgct

SEQ ID NO: 5252 - DNA, 22 bp, Arabidopsis thaliana
taatgtgatgttgttcttgatg

SEQ ID NO: 5253 - DNA, 19 bp, Arabidopsis thaliana
ttcttagtcttcttcttct

SEQ ID NO: 5254 - DNA, 21 bp, Arabidopsis thaliana
tgagtgtgtgagagagagaat

SEQ ID NO: 5255 - DNA, 20 bp, Arabidopsis thaliana
tgatgaagaagatgaagatg

SEQ ID NO: 5256 - DNA, 20 bp, Arabidopsis thaliana
agagaagaagcttgtctcag

SEQ ID NO: 5257 - DNA, 22 bp, Arabidopsis thaliana
aagtacaagtacaagtacaaga

SEQ ID NO: 5258 - DNA, 18 bp, Arabidopsis thaliana
tgcaagaagaagatgaag

SEQ ID NO: 5259 - DNA, 18 bp, Arabidopsis thaliana
cattgttgatgatgctgt

SEQ ID NO: 5260 - DNA, 18 bp, Arabidopsis thaliana
tagagagggagagaagaa

SEQ ID NO: 5261 - DNA, 21 bp, Arabidopsis thaliana
gtttggtagataattgaggaa

SEQ ID NO: 5262 - DNA, 19 bp, Arabidopsis thaliana
tgtggtagatatatgtagt

SEQ ID NO: 5263 - DNA, 21 bp, Arabidopsis thaliana
ttgaacatggtttattaggaa

SEQ ID NO: 5264 - DNA, 18 bp, Arabidopsis thaliana
tgtccattgattgttgtg

SEQ ID NO: 5265 - DNA, 22 bp, Arabidopsis thaliana
tatgatgatcttgaatcttgat

SEQ ID NO: 5266 - DNA, 19 bp, Arabidopsis thaliana
ttggttgttcttgatatct

SEQ ID NO: 5267 - DNA, 23 bp, Arabidopsis thaliana
tgtgagtgagagagagtgtgtat

SEQ ID NO: 5268 - DNA, 18 bp, Arabidopsis thaliana
tagaatgatgatgttgga

SEQ ID NO: 5269 - DNA, 18 bp, Arabidopsis thaliana
ctaaagttgctagagtgt

SEQ ID NO: 5270 - DNA, 21 bp, Arabidopsis thaliana
aacttgaatgttgctgcagct

SEQ ID NO: 5271 - DNA, 20 bp, Arabidopsis thaliana
tgtgtccttttgttgcagct

SEQ ID NO: 5272 - DNA, 19 bp, Arabidopsis thaliana
agagttttgttgttggagt

SEQ ID NO: 5273 - DNA, 23 bp, Arabidopsis thaliana
tgtgggtgtgtaactgtgtatgt

SEQ ID NO: 5274 - DNA, 22 bp, Arabidopsis thaliana
tatgtgtatgtgtatgtgtatg

SEQ ID NO: 5275 - DNA, 20 bp, Arabidopsis thaliana
atatacacacacactcataa

SEQ ID NO: 5276 - DNA, 20 bp, Arabidopsis thaliana
aatgtcattttactgaattg

SEQ ID NO: 5277 - DNA, 23 bp, Arabidopsis thaliana
tctttgatgttgttgatcttggt

SEQ ID NO: 5278 - DNA, 19 bp, Arabidopsis thaliana
tgacctcgcatgttgttgt

SEQ ID NO: 5279 - DNA, 23 bp, Arabidopsis thaliana
tcttcttcgtcttcttcatcttc

SEQ ID NO: 5280 - DNA, 22 bp, Arabidopsis thaliana
attggactgaagggagctccct

SEQ ID NO: 5281 - DNA, 19 bp, Arabidopsis thaliana
ttagagagttttgtgtgtt

SEQ ID NO: 5282 - DNA, 23 bp, Arabidopsis thaliana
agatagagagactgtgtgttttg

SEQ ID NO: 5283 - DNA, 19 bp, Arabidopsis thaliana
ttgactctttctcttcatg

SEQ ID NO: 5284 - DNA, 21 bp, Arabidopsis thaliana
ccacaggatgaagaatctgct

SEQ ID NO: 5285 - DNA, 23 bp, Arabidopsis thaliana
gttcttgctggagatgtgagtga

SEQ ID NO: 5286 - DNA, 19 bp, Arabidopsis thaliana
agctttgttgttgcagctg

SEQ ID NO: 5287 - DNA, 21 bp, Arabidopsis thaliana
ctatgacaatgcagtaagaga

SEQ ID NO: 5288 - DNA, 18 bp, Arabidopsis thaliana
tttgtgtggttgtgcaca

SEQ ID NO: 5289 - DNA, 23 bp, Arabidopsis thaliana
tgatctgcttgatcttgccatgt

SEQ ID NO: 5290 - DNA, 19 bp, Arabidopsis thaliana
tgactaggatattgttggt

SEQ ID NO: 5291 - DNA, 20 bp, Arabidopsis thaliana
tcttgctcgaagtctacagt

SEQ ID NO: 5292 - DNA, 19 bp, Arabidopsis thaliana
tgcaaagtgtgttagctca

SEQ ID NO: 5293 - DNA, 23 bp, Arabidopsis thaliana
tgtttgtgtgtctgtatgtggaa

SEQ ID NO: 5294 - DNA, 21 bp, Arabidopsis thaliana
ctgtttgattgattagtgaaa

SEQ ID NO: 5295 - DNA, 19 bp, Arabidopsis thaliana
tgaaaagattggtgtagta

SEQ ID NO: 5296 - DNA, 20 bp, Arabidopsis thaliana
tcttgcagcagaacttgtgt

SEQ ID NO: 5297 - DNA, 20 bp, Arabidopsis thaliana
aatttgtctgtgtatgtgta

SEQ ID NO: 5298 - DNA, 20 bp, Arabidopsis thaliana
tgaaagtggttttgatttgg

SEQ ID NO: 5299 - DNA, 21 bp, Arabidopsis thaliana
tagtccggttttggatacgtg

SEQ ID NO: 5300 - DNA, 20 bp, Arabidopsis thaliana
tgatgatgatgagaaagctg

SEQ ID NO: 5301 - DNA, 22 bp, Arabidopsis thaliana
tcactgtgagagtaagagagag

SEQ ID NO: 5302 - DNA, 20 bp, Arabidopsis thaliana
ctgctgttgctgctggtatc

SEQ ID NO: 5303 - DNA, 23 bp, Arabidopsis thaliana
tcagtgtgtgtgtatcagtgtgt

SEQ ID NO: 5304 - DNA, 20 bp, Arabidopsis thaliana
ttgtctgtggatgttgaact

SEQ ID NO: 5305 - DNA, 23 bp, Arabidopsis thaliana
gatcttcatcatcatcatcgtca

SEQ ID NO: 5306 - DNA, 23 bp, Arabidopsis thaliana
aagatgatgatgatgatgaagaa

SEQ ID NO: 5307 - DNA, 19 bp, Arabidopsis thaliana
tgcatcgtgaacagggtct

SEQ ID NO: 5308 - DNA, 22 bp, Arabidopsis thaliana
tcttgcttaaatgagtattcca

SEQ ID NO: 5309 - DNA, 19 bp, Arabidopsis thaliana
agagagaagttggtgaagt

SEQ ID NO: 5310 - DNA, 19 bp, Arabidopsis thaliana
tgagctatttgttgttgtt

SEQ ID NO: 5311 - DNA, 20 bp, Arabidopsis thaliana
taacagtgagtgtttgtgtt

SEQ ID NO: 5312 - DNA, 20 bp, Arabidopsis thaliana
taaagatgaagattcttctt

SEQ ID NO: 5313 - DNA, 21 bp, Arabidopsis thaliana
atgtgcttcttcttgcagaag

SEQ ID NO: 5314 - DNA, 18 bp, Arabidopsis thaliana
tttgatcttgatttggag

SEQ ID NO: 5315 - DNA, 18 bp, Arabidopsis thaliana
tgaccaggatcttctgtg

SEQ ID NO: 5316 - DNA, 23 bp, Arabidopsis thaliana
caccaacatcttcttcttcttct

SEQ ID NO: 5317 - DNA, 19 bp, Arabidopsis thaliana
tgtgaggatttttgtgtgt

SEQ ID NO: 5318 - DNA, 20 bp, Arabidopsis thaliana
agagagcatgcattgttgac

SEQ ID NO: 5319 - DNA, 23 bp, Arabidopsis thaliana
tcttcatcatcatcatcatcatc

SEQ ID NO: 5320 - DNA, 23 bp, Arabidopsis thaliana
tgctcatcgtcatcatcatcatg

SEQ ID NO: 5321 - DNA, 19 bp, Arabidopsis thaliana
tgcatttgtgttgctttgc

SEQ ID NO: 5322 - DNA, 19 bp, Arabidopsis thaliana
agagatctgaaactgatga

SEQ ID NO: 5323 - DNA, 18 bp, Arabidopsis thaliana
ttgattcttaatgtggta

SEQ ID NO: 5324 - DNA, 23 bp, Arabidopsis thaliana
tgacagaagagagtgagcacatg

SEQ ID NO: 5325 - DNA, 20 bp, Arabidopsis thaliana
tttcttctgattttgttgtt

SEQ ID NO: 5326 - DNA, 19 bp, Arabidopsis thaliana
gaatctcttcatgctgtta

SEQ ID NO: 5327 - DNA, 19 bp, Arabidopsis thaliana
tcgttggtcttgatgtgga

SEQ ID NO: 5328 - DNA, 19 bp, Arabidopsis thaliana
gatgctgttggagctggtg

SEQ ID NO: 5329 - DNA, 20 bp, Arabidopsis thaliana
tgctgcggttgctgctgctg

SEQ ID NO: 5330 - DNA, 21 bp, Arabidopsis thaliana
ttgaatgagtgtatgttgatc

SEQ ID NO: 5331 - DNA, 20 bp, Arabidopsis thaliana
atgtttgttgttcttgattt

SEQ ID NO: 5332 - DNA, 19 bp, Arabidopsis thaliana
aaactcttcttctgcttca

SEQ ID NO: 5333 - DNA, 18 bp, Arabidopsis thaliana
tgctgatgttgttgttgc

SEQ ID NO: 5334 - DNA, 18 bp, Arabidopsis thaliana
tgtgatattggtgccgct

SEQ ID NO: 5335 - DNA, 20 bp, Arabidopsis thaliana
actggaatgaatcacttcag

SEQ ID NO: 5336 - DNA, 20 bp, Arabidopsis thaliana
aggatgctcttgtgaatgtg

SEQ ID NO: 5337 - DNA, 21 bp, Arabidopsis thaliana
actggaatgaatcacttcaga

SEQ ID NO: 5338 - DNA, 21 bp, Arabidopsis thaliana
atcgtcgtcttcatcatcatc

SEQ ID NO: 5339 - DNA, 22 bp, Arabidopsis thaliana
tgagatgatggagaatggttgt

SEQ ID NO: 5340 - DNA, 18 bp, Arabidopsis thaliana
gtgctcactctcttctgt

SEQ ID NO: 5341 - DNA, 21 bp, Arabidopsis thaliana
cttgtgagctacttgtttcat

SEQ ID NO: 5342 - DNA, 21 bp, Arabidopsis thaliana
tgaccagtgattttgttgcgt

SEQ ID NO: 5343 - DNA, 22 bp, Arabidopsis thaliana
cactctggttttgtttgcttgt

SEQ ID NO: 5344 - DNA, 20 bp, Arabidopsis thaliana
cattgtctgtattgttgctt

SEQ ID NO: 5345 - DNA, 19 bp, Arabidopsis thaliana
ccctttgttgttgttggta

SEQ ID NO: 5346 - DNA, 20 bp, Arabidopsis thaliana
atcatcatcttcttcgtcaa

SEQ ID NO: 5347 - DNA, 22 bp, Arabidopsis thaliana
attatgaatgctgaggatgttg

SEQ ID NO: 5348 - DNA, 19 bp, Arabidopsis thaliana
tgtgttcataagttgttgt

SEQ ID NO: 5349 - DNA, 19 bp, Arabidopsis thaliana
aagtcatcatcatctttgt

SEQ ID NO: 5350 - DNA, 18 bp, Arabidopsis thaliana
tcaacactgaggttgaag

SEQ ID NO: 5351 - DNA, 19 bp, Arabidopsis thaliana
ttggttgatgatgaagatg

SEQ ID NO: 5352 - DNA, 22 bp, Arabidopsis thaliana
attgcttcgacaagattctgat

SEQ ID NO: 5353 - DNA, 21 bp, Arabidopsis thaliana
tgtggttcaagttcatggtct

SEQ ID NO: 5354 - DNA, 21 bp, Arabidopsis thaliana
gagcttctgctgctgctgcag

SEQ ID NO: 5355 - DNA, 22 bp, Arabidopsis thaliana
tcttggtgtgtgtgcaggttga

SEQ ID NO: 5356 - DNA, 21 bp, Arabidopsis thaliana
agactcttcttctccttgaag

SEQ ID NO: 5357 - DNA, 20 bp, Arabidopsis thaliana
tgagattgcagagcatgttg

SEQ ID NO: 5358 - DNA, 21 bp, Arabidopsis thaliana
tgtgttctcatcttcttgtgg

SEQ ID NO: 5359 - DNA, 19 bp, Arabidopsis thaliana
gcagcaccagtctcgagct

SEQ ID NO: 5360 - DNA, 19 bp, Arabidopsis thaliana
agagctatggagtttgagt

SEQ ID NO: 5361 - DNA, 23 bp, Arabidopsis thaliana
tcgtcgtcttcttcatcttcgtc

SEQ ID NO: 5362 - DNA, 22 bp, Arabidopsis thaliana
aactgactgtaatagttgtgag

SEQ ID NO: 5363 - DNA, 19 bp, Arabidopsis thaliana
tcctcctgatgtgattcag

SEQ ID NO: 5364 - DNA, 19 bp, Arabidopsis thaliana
tgacaccttttgttgcgtt

SEQ ID NO: 5365 - DNA, 19 bp, Arabidopsis thaliana
tgatacttggatctgctct

SEQ ID NO: 5366 - DNA, 20 bp, Arabidopsis thaliana
gtctctggttttgtttcttt

SEQ ID NO: 5367 - DNA, 18 bp, Arabidopsis thaliana
aacagagcaaagtcagtg

SEQ ID NO: 5368 - DNA, 18 bp, Arabidopsis thaliana
tgaggttttgttggttga

SEQ ID NO: 5369 - DNA, 20 bp, Arabidopsis thaliana
taagtcttgttgatccactt

SEQ ID NO: 5370 - DNA, 19 bp, Arabidopsis thaliana
aatctgattaagtttctga

SEQ ID NO: 5371 - DNA, 23 bp, Arabidopsis thaliana
ttggtagtgagtagttgaagtga

SEQ ID NO: 5372 - DNA, 20 bp, Arabidopsis thaliana
acagagagagagagagaggc

SEQ ID NO: 5373 - DNA, 21 bp, Arabidopsis thaliana
atatgtctgatagttttgcgt

SEQ ID NO: 5374 - DNA, 20 bp, Arabidopsis thaliana
tcatcgtgatgatgatcgtg

SEQ ID NO: 5375 - DNA, 23 bp, Arabidopsis thaliana
ctcgtcttcatgatgatgatgat

SEQ ID NO: 5376 - DNA, 22 bp, Arabidopsis thaliana
tctcttcatttgatgatgatgt

SEQ ID NO: 5377 - DNA, 19 bp, Arabidopsis thaliana
agcttcttcttctacctca

SEQ ID NO: 5378 - DNA, 23 bp, Arabidopsis thaliana
gtggagctttgatgatgttgatg

SEQ ID NO: 5379 - DNA, 20 bp, Arabidopsis thaliana
agagctagtaggatttagtg

SEQ ID NO: 5380 - DNA, 23 bp, Arabidopsis thaliana
cttgagcattgttgttgttgtgt

SEQ ID NO: 5381 - DNA, 23 bp, Arabidopsis thaliana
tttgtgtgtgtcagtgtgtgtat

SEQ ID NO: 5382 - DNA, 20 bp, Arabidopsis thaliana
tcttgactttgtttgttgtt

SEQ ID NO: 5383 - DNA, 21 bp, Arabidopsis thaliana
agttgttgttgttgttgcaga

SEQ ID NO: 5384 - DNA, 23 bp, Arabidopsis thaliana
ttgttgttgttcttcatctttct

SEQ ID NO: 5385 - DNA, 20 bp, Arabidopsis thaliana
tgtttcatgttctggttgtt

SEQ ID NO: 5386 - DNA, 18 bp, Arabidopsis thaliana
tgagagatattgaaggat

SEQ ID NO: 5387 - DNA, 22 bp, Arabidopsis thaliana
agtgtgtgtgtgtatgagtatt

SEQ ID NO: 5388 - DNA, 23 bp, Arabidopsis thaliana
tgactgttcatgatcttcttggt

SEQ ID NO: 5389 - DNA, 20 bp, Arabidopsis thaliana
aaaatgaagatgaagatgat

SEQ ID NO: 5390 - DNA, 23 bp, Arabidopsis thaliana
cctcatcatcatcatcgtcatca

SEQ ID NO: 5391 - DNA, 19 bp, Arabidopsis thaliana
aagagcaaaggagtttgtg

SEQ ID NO: 5392 - DNA, 18 bp, Arabidopsis thaliana
tgtttcttcatcaacatc

SEQ ID NO: 5393 - DNA, 18 bp, Arabidopsis thaliana
ttctccagcaccaccacc

SEQ ID NO: 5394 - DNA, 22 bp, Arabidopsis thaliana
attctcgttgttcttgtgagtg

SEQ ID NO: 5395 - DNA, 18 bp, Arabidopsis thaliana
tgagtgttgtgttgtgat

SEQ ID NO: 5396 - DNA, 20 bp, Arabidopsis thaliana
agtccatgctttgtgaggtt

SEQ ID NO: 5397 - DNA, 23 bp, Arabidopsis thaliana
agttttcttgttcttcttcagca

SEQ ID NO: 5398 - DNA, 22 bp, Arabidopsis thaliana
aatcttgatgtccattgttgtt

SEQ ID NO: 5399 - DNA, 21 bp, Arabidopsis thaliana
tgagcttgctttgtgtgttga

SEQ ID NO: 5400 - DNA, 22 bp, Arabidopsis thaliana
ttatgtcttgttcttgatcttg

SEQ ID NO: 5401 - DNA, 19 bp, Arabidopsis thaliana
gtggtggtggcgctggagg

SEQ ID NO: 5402 - DNA, 18 bp, Arabidopsis thaliana
aactgcaaacactttgtt

SEQ ID NO: 5403 - DNA, 20 bp, Arabidopsis thaliana
tttctctcttgttcttgagt

SEQ ID NO: 5404 - DNA, 18 bp, Arabidopsis thaliana
aggttcgattttgatgtg

SEQ ID NO: 5405 - DNA, 20 bp, Arabidopsis thaliana
aagagagagagaatgtggtg

SEQ ID NO: 5406 - DNA, 21 bp, Arabidopsis thaliana
tactacttgcagtgatgttgt

SEQ ID NO: 5407 - DNA, 21 bp, Arabidopsis thaliana
tcagagcatatcaagctgtga

SEQ ID NO: 5408 - DNA, 23 bp, Arabidopsis thaliana
ttgcaggtacttgattgtgttgt

SEQ ID NO: 5409 - DNA, 21 bp, Arabidopsis thaliana
tgtgcatgcatggttgagtgt

SEQ ID NO: 5410 - DNA, 23 bp, Arabidopsis thaliana
tcagtgtcagtgtgtgttcttga

SEQ ID NO: 5411 - DNA, 19 bp, Arabidopsis thaliana
ttcattcttcttgaaggca

SEQ ID NO: 5412 - DNA, 20 bp, Arabidopsis thaliana
tagtatgatgatgatggtga

SEQ ID NO: 5413 - DNA, 20 bp, Arabidopsis thaliana
tgtcagtttctcaatttccc

SEQ ID NO: 5414 - DNA, 21 bp, Arabidopsis thaliana
tcagtctttgtctgtgtctct

SEQ ID NO: 5415 - DNA, 23 bp, Arabidopsis thaliana
atctgtgtgtgattgctgaatag

SEQ ID NO: 5416 - DNA, 21 bp, Arabidopsis thaliana
tcattgagtgcagcgttgatg

SEQ ID NO: 5417 - DNA, 22 bp, Arabidopsis thaliana
aatttcgttttgtttttcattg

SEQ ID NO: 5418 - DNA, 18 bp, Arabidopsis thaliana
gagcagagcaggcaaaga

SEQ ID NO: 5419 - DNA, 21 bp, Arabidopsis thaliana
attgttgctgatacttcttgt

SEQ ID NO: 5420 - DNA, 20 bp, Arabidopsis thaliana
agaacaagaagaagaagaag

SEQ ID NO: 5421 - DNA, 19 bp, Arabidopsis thaliana
attttggtgttctgattct

SEQ ID NO: 5422 - DNA, 18 bp, Arabidopsis thaliana
agtgtagatcgacacact

SEQ ID NO: 5423 - DNA, 18 bp, Arabidopsis thaliana
caaccgattcccaaaagc

SEQ ID NO: 5424 - DNA, 21 bp, Arabidopsis thaliana
agtagtgtttccttgtttgaa

SEQ ID NO: 5425 - DNA, 21 bp, Arabidopsis thaliana
tctcagtctctctctctctct

SEQ ID NO: 5426 - DNA, 19 bp, Arabidopsis thaliana
tgtctcgatttgtgacgga

SEQ ID NO: 5427 - DNA, 21 bp, Arabidopsis thaliana
cgaaactggtgtcgatcgaca

SEQ ID NO: 5428 - DNA, 18 bp, Arabidopsis thaliana
ttgttgttgatgtagctg

SEQ ID NO: 5429 - DNA, 22 bp, Arabidopsis thaliana
taagctgagcctgtgtgtgtgt

SEQ ID NO: 5430 - DNA, 21 bp, Arabidopsis thaliana
agaggttggagttgttggtct

SEQ ID NO: 5431 - DNA, 18 bp, Arabidopsis thaliana
catttgtgtgtgattgtg

SEQ ID NO: 5432 - DNA, 19 bp, Arabidopsis thaliana
aaagtgttcttgtccttgt

SEQ ID NO: 5433 - DNA, 18 bp, Arabidopsis thaliana
tttggttttacagcagtt

SEQ ID NO: 5434 - DNA, 18 bp, Arabidopsis thaliana
tgaaccctggtggtggat

SEQ ID NO: 5435 - DNA, 22 bp, Arabidopsis thaliana
tgaccttgttgttgctgtggag

SEQ ID NO: 5436 - DNA, 23 bp, Arabidopsis thaliana
gtatgtgatctgaatctcatgtg

SEQ ID NO: 5437 - DNA, 20 bp, Arabidopsis thaliana
gaacaagtttgattttgttg

SEQ ID NO: 5438 - DNA, 22 bp, Arabidopsis thaliana
atgatggtgatgatcaaggaga

SEQ ID NO: 5439 - DNA, 21 bp, Arabidopsis thaliana
atttagattggtggttttcac

SEQ ID NO: 5440 - DNA, 20 bp, Arabidopsis thaliana
tgagtgtgtctgagatcttg

SEQ ID NO: 5441 - DNA, 22 bp, Arabidopsis thaliana
tcagcgtcagcagcagcaggac

SEQ ID NO: 5442 - DNA, 18 bp, Arabidopsis thaliana
ttctcatcttcatgctca

SEQ ID NO: 5443 - DNA, 21 bp, Arabidopsis thaliana
ttgtttgctcatttagttgat

SEQ ID NO: 5444 - DNA, 21 bp, Arabidopsis thaliana
gttctgctgcagctgctgttg

SEQ ID NO: 5445 - DNA, 18 bp, Arabidopsis thaliana
tacaccttgattgtctga

SEQ ID NO: 5446 - DNA, 23 bp, Arabidopsis thaliana
tctgtcatgcagtgaatgtgtgt

SEQ ID NO: 5447 - DNA, 18 bp, Arabidopsis thaliana
agagaatacttggtgtgg

SEQ ID NO: 5448 - DNA, 20 bp, Arabidopsis thaliana
tcaacaaagatgatggtgtt

SEQ ID NO: 5449 - DNA, 20 bp, Arabidopsis thaliana
gagtctttggctttgtgtct

SEQ ID NO: 5450 - DNA, 18 bp, Arabidopsis thaliana
catgggcgtcagcggcgg

SEQ ID NO: 5451 - DNA, 20 bp, Arabidopsis thaliana
gttctgctgcagctgctgtt

SEQ ID NO: 5452 - DNA, 18 bp, Arabidopsis thaliana
gagaggtcgagttgcggt

SEQ ID NO: 5453 - DNA, 22 bp, Arabidopsis thaliana
gatactgatgatggtccatgat

SEQ ID NO: 5454 - DNA, 20 bp, Arabidopsis thaliana
catcatcatcatcatcaaaa

SEQ ID NO: 5455 - DNA, 18 bp, Arabidopsis thaliana
tgaaccctggtggtggat

SEQ ID NO: 5456 - DNA, 18 bp, Arabidopsis thaliana
tgaaccctggtggtggat

SEQ ID NO: 5457 - DNA, 22 bp, Arabidopsis thaliana
tttgatgtagatgatgaagatg

SEQ ID NO: 5458 - DNA, 20 bp, Arabidopsis thaliana
gaatctgagagagagagagt

SEQ ID NO: 5459 - DNA, 20 bp, Arabidopsis thaliana
tttgaagctgttgatgagct

SEQ ID NO: 5460 - DNA, 18 bp, Arabidopsis thaliana
tggagctgttgacgagct

SEQ ID NO: 5461 - DNA, 23 bp, Arabidopsis thaliana
tcaggatgttgttgttgctgcag

SEQ ID NO: 5462 - DNA, 18 bp, Arabidopsis thaliana
aagacaattgacttactc

SEQ ID NO: 5463 - DNA, 18 bp, Arabidopsis thaliana
agtgcatcctagttttgc

SEQ ID NO: 5464 - DNA, 18 bp, Arabidopsis thaliana
agcactttgatgttggtg

SEQ ID NO: 5465 - DNA, 18 bp, Arabidopsis thaliana
ttgttgttgatgtagctg

SEQ ID NO: 5466 - DNA, 20 bp, Arabidopsis thaliana
taaatgcatgttaactagtg

SEQ ID NO: 5467 - DNA, 18 bp, Arabidopsis thaliana
atcatgttgtatgttgaa

SEQ ID NO: 5468 - DNA, 19 bp, Arabidopsis thaliana
ctgcatcatcagctgaagc

SEQ ID NO: 5469 - DNA, 18 bp, Arabidopsis thaliana
tcgcatgtagatgggttt

SEQ ID NO: 5470 - DNA, 18 bp, Arabidopsis thaliana
agactactttggagatag

SEQ ID NO: 5471 - DNA, 23 bp, Arabidopsis thaliana
aggaagaagatgaagcagaagat

SEQ ID NO: 5472 - DNA, 19 bp, Arabidopsis thaliana
taagtcatcatcatcctca

SEQ ID NO: 5473 - DNA, 23 bp, Arabidopsis thaliana
ttaaaggtagtttttagttgttg

SEQ ID NO: 5474 - DNA, 19 bp, Arabidopsis thaliana
tgagtgtttatttggatga

SEQ ID NO: 5475 - DNA, 19 bp, Arabidopsis thaliana
atctctgtttttgatggtt

SEQ ID NO: 5476 - DNA, 18 bp, Arabidopsis thaliana
tagatgatgatgttgcag

SEQ ID NO: 5477 - DNA, 20 bp, Arabidopsis thaliana
tagccactcctagtttgagt

SEQ ID NO: 5478 - DNA, 20 bp, Arabidopsis thaliana
agttaacgttccttttgcag

SEQ ID NO: 5479 - DNA, 19 bp, Arabidopsis thaliana
ggtgatggtgttggtggca

SEQ ID NO: 5480 - DNA, 20 bp, Arabidopsis thaliana
aatgaaaggttatgttgttg

SEQ ID NO: 5481 - DNA, 20 bp, Arabidopsis thaliana
aatgaaaggttatgttgttg

SEQ ID NO: 5482 - DNA, 19 bp, Arabidopsis thaliana
ttctcttatgatgatgatg

SEQ ID NO: 5483 - DNA, 20 bp, Arabidopsis thaliana
agagagcatgcattgttgac

SEQ ID NO: 5484 - DNA, 19 bp, Arabidopsis thaliana
tagttgtgtgtgcttcttc

SEQ ID NO: 5485 - DNA, 21 bp, Arabidopsis thaliana
tgctgcagagggtcttgcttc

SEQ ID NO: 5486 - DNA, 21 bp, Arabidopsis thaliana
tcgtgttcttcatcttcgtct

SEQ ID NO: 5487 - DNA, 23 bp, Arabidopsis thaliana
attgttgttgctgattcttcatt

SEQ ID NO: 5488 - DNA, 21 bp, Arabidopsis thaliana
aacagttgagattttcatgtg

SEQ ID NO: 5489 - DNA, 20 bp, Arabidopsis thaliana
taggtgaaagcttagccaca

SEQ ID NO: 5490 - DNA, 23 bp, Arabidopsis thaliana
ttgaagttgttgtttgatagatc

SEQ ID NO: 5491 - DNA, 23 bp, Arabidopsis thaliana
acagtgagtgagagagagagtga

SEQ ID NO: 5492 - DNA, 23 bp, Arabidopsis thaliana
aatgatgttcatcatgatactga

SEQ ID NO: 5493 - DNA, 23 bp, Arabidopsis thaliana
agctgtttgtgtctctgtttcac

SEQ ID NO: 5494 - DNA, 23 bp, Arabidopsis thaliana
agtcacagagagagagagagaga

SEQ ID NO: 5495 - DNA, 22 bp, Arabidopsis thaliana
atcaaggacatgatgaagatga

SEQ ID NO: 5496 - DNA, 23 bp, Arabidopsis thaliana
tttgtatgtgttcatgtgtgcat

SEQ ID NO: 5497 - DNA, 22 bp, Arabidopsis thaliana
tttgtatgtgttcatgtgtgca

SEQ ID NO: 5498 - DNA, 19 bp, Arabidopsis thaliana
tgtgagttttctgatttca

SEQ ID NO: 5499 - DNA, 21 bp, Arabidopsis thaliana
gaagtccatcgattttgtcta

SEQ ID NO: 5500 - DNA, 18 bp, Arabidopsis thaliana
gtgccttgtagatggttt

SEQ ID NO: 5501 - DNA, 18 bp, Arabidopsis thaliana
gtgccttgtagatggttt

SEQ ID NO: 5502 - DNA, 19 bp, Arabidopsis thaliana
tgtcatcatcatcattgca

SEQ ID NO: 5503 - DNA, 19 bp, Arabidopsis thaliana
agagacagagagagagaga

SEQ ID NO: 5504 - DNA, 18 bp, Arabidopsis thaliana
atgatgatgaagaaggag

SEQ ID NO: 5505 - DNA, 18 bp, Arabidopsis thaliana
actgagagagagagagag

SEQ ID NO: 5506 - DNA, 19 bp, Arabidopsis thaliana
ttctgagtcaagttgttgt

SEQ ID NO: 5507 - DNA, 19 bp, Arabidopsis thaliana
tctgctatgtttctcgggg

SEQ ID NO: 5508 - DNA, 19 bp, Arabidopsis thaliana
aatgtcatgatttgcttca

SEQ ID NO: 5509 - DNA, 22 bp, Arabidopsis thaliana
tctctctctctgtctctcttac

SEQ ID NO: 5510 - DNA, 22 bp, Arabidopsis thaliana
taagatccggactacaacaaag

SEQ ID NO: 5511 - DNA, 18 bp, Arabidopsis thaliana
agagactgaatgatgttg

SEQ ID NO: 5512 - DNA, 18 bp, Arabidopsis thaliana
gagaagagtttgggggaa

SEQ ID NO: 5513 - DNA, 21 bp, Arabidopsis thaliana
ttatgtcttgttgatctcaat

SEQ ID NO: 5514 - DNA, 19 bp, Arabidopsis thaliana
gaaacataatctaggttgt

SEQ ID NO: 5515 - DNA, 19 bp, Arabidopsis thaliana
agtgcagttttggaaggtt

SEQ ID NO: 5516 - DNA, 21 bp, Arabidopsis thaliana
agttgtgtatgcatgtagctg

SEQ ID NO: 5517 - DNA, 19 bp, Arabidopsis thaliana
atttgatgctgattcttca

SEQ ID NO: 5518 - DNA, 20 bp, Arabidopsis thaliana
tgttgttgatgattgtacaa

SEQ ID NO: 5519 - DNA, 21 bp, Arabidopsis thaliana
aagataagcgccttagttctg

SEQ ID NO: 5520 - DNA, 19 bp, Arabidopsis thaliana
atatctcttcttgctgtct

SEQ ID NO: 5521 - DNA, 20 bp, Arabidopsis thaliana
tgtgcttttgcatgccatag

SEQ ID NO: 5522 - DNA, 19 bp, Arabidopsis thaliana
tatctatgtggatgtgatg

SEQ ID NO: 5523 - DNA, 19 bp, Arabidopsis thaliana
taggtgtgtgtacatgtac

SEQ ID NO: 5524 - DNA, 18 bp, Arabidopsis thaliana
atgagcatgaagattcat

SEQ ID NO: 5525 - DNA, 23 bp, Arabidopsis thaliana
aatgtgtgactgtgactgtgact

SEQ ID NO: 5526 - DNA, 23 bp, Arabidopsis thaliana
ctagaaagtggttttgttttctt

SEQ ID NO: 5527 - DNA, 23 bp, Arabidopsis thaliana
tgtagatgatgatgatgatggtg

SEQ ID NO: 5528 - DNA, 22 bp, Arabidopsis thaliana
atgttgatcttggttgttcttt

SEQ ID NO: 5529 - DNA, 23 bp, Arabidopsis thaliana
gtagtgtgtgtgtagatcaactg

SEQ ID NO: 5530 - DNA, 20 bp, Arabidopsis thaliana
tttggttttgttgttgttga

SEQ ID NO: 5531 - DNA, 20 bp, Arabidopsis thaliana
gctctgataccatatggaag

SEQ ID NO: 5532 - DNA, 21 bp, Arabidopsis thaliana
tcagagagagattgaagctgt

SEQ ID NO: 5533 - DNA, 21 bp, Arabidopsis thaliana
tgcctggctccctgtatgcca

SEQ ID NO: 5534 - DNA, 22 bp, Arabidopsis thaliana
aaagtgcttcaattttgactaa

SEQ ID NO: 5535 - DNA, 19 bp, Arabidopsis thaliana
caagtatttgataggagct

SEQ ID NO: 5536 - DNA, 19 bp, Arabidopsis thaliana
aagagaagtggaagtgttg

SEQ ID NO: 5537 - DNA, 21 bp, Arabidopsis thaliana
taagaccttgcttcttgaaga

SEQ ID NO: 5538 - DNA, 20 bp, Arabidopsis thaliana
aaggacctgttggtggtggt

SEQ ID NO: 5539 - DNA, 19 bp, Arabidopsis thaliana
tcagtcatcacttgcaatc

SEQ ID NO: 5540 - DNA, 23 bp, Arabidopsis thaliana
tcctgatgctcatgatgctgaat

SEQ ID NO: 5541 - DNA, 23 bp, Arabidopsis thaliana
ctgtatcttcttcatcttgctta

SEQ ID NO: 5542 - DNA, 23 bp, Arabidopsis thaliana
actgtatcttcttcatcttgctt

SEQ ID NO: 5543 - DNA, 23 bp, Arabidopsis thaliana
ttggatgatcatgttgatcgttg

SEQ ID NO: 5544 - DNA, 20 bp, Arabidopsis thaliana
tgtgtgtgtgtgtaataggg

SEQ ID NO: 5545 - DNA, 21 bp, Arabidopsis thaliana
agttaggtattcaaggattga

SEQ ID NO: 5546 - DNA, 21 bp, Arabidopsis thaliana
tacgagccacttgaaactgaa

SEQ ID NO: 5547 - DNA, 18 bp, Arabidopsis thaliana
atctacaacatggtcgac

SEQ ID NO: 5548 - DNA, 21 bp, Arabidopsis thaliana
tcattgagtgcatcgttgatg

SEQ ID NO: 5549 - DNA, 20 bp, Arabidopsis thaliana
agtctgtgttgttgttgttg

SEQ ID NO: 5550 - DNA, 20 bp, Arabidopsis thaliana
gcaagtggatgtgactgtgt

SEQ ID NO: 5551 - DNA, 19 bp, Arabidopsis thaliana
cactggaggtggtgggctg

SEQ ID NO: 5552 - DNA, 19 bp, Arabidopsis thaliana
atgtgtgtgtgtttgtctt

SEQ ID NO: 5553 - DNA, 19 bp, Arabidopsis thaliana
atgtgtgtgtgtttgtctt

SEQ ID NO: 5554 - DNA, 19 bp, Arabidopsis thaliana
atgtgtgtgtgtttgtctt

SEQ ID NO: 5555 - DNA, 19 bp, Arabidopsis thaliana
atgtgtgtgtgtttgtctt

SEQ ID NO: 5556 - DNA, 19 bp, Arabidopsis thaliana
atgtgtgtgtgtttgtctt

SEQ ID NO: 5557 - DNA, 19 bp, Arabidopsis thaliana
tgctgttgctggtcttgtg

SEQ ID NO: 5558 - DNA, 22 bp, Arabidopsis thaliana
tgagatctgaaatcaaaagttg

SEQ ID NO: 5559 - DNA, 23 bp, Arabidopsis thaliana
tcatttgatgatgttgtagagcc

SEQ ID NO: 5560 - DNA, 19 bp, Arabidopsis thaliana
ttcaagatgttgatggaga

SEQ ID NO: 5561 - DNA, 21 bp, Arabidopsis thaliana
ggagctgcctctcaggctgcg

SEQ ID NO: 5562 - DNA, 22 bp, Arabidopsis thaliana
cgtcatcttcttcttcgtctac

SEQ ID NO: 5563 - DNA, 20 bp, Arabidopsis thaliana
tctcacactcttactctctc

SEQ ID NO: 5564 - DNA, 22 bp, Arabidopsis thaliana
gtgagctctgtctctctgctta

SEQ ID NO: 5565 - DNA, 21 bp, Arabidopsis thaliana
ttgtgattggttatatagtga

SEQ ID NO: 5566 - DNA, 22 bp, Arabidopsis thaliana
taagtgcttgtatatagtatat

SEQ ID NO: 5567 - DNA, 23 bp, Arabidopsis thaliana
tatgtgtgtgtgtcagtgtgtat

SEQ ID NO: 5568 - DNA, 20 bp, Arabidopsis thaliana
attcctcttttattggttga

SEQ ID NO: 5569 - DNA, 18 bp, Arabidopsis thaliana
gaattgtcaatttgttgt

SEQ ID NO: 5570 - DNA, 20 bp, Arabidopsis thaliana
aggaagaagaagaagatgaa

SEQ ID NO: 5571 - DNA, 18 bp, Arabidopsis thaliana
tgtctattttggatgatg

SEQ ID NO: 5572 - DNA, 18 bp, Arabidopsis thaliana
tgagagtcttagaaaagt

SEQ ID NO: 5573 - DNA, 21 bp, Arabidopsis thaliana
atgaatgtatgcatgtatgaa

SEQ ID NO: 5574 - DNA, 22 bp, Arabidopsis thaliana
tgaatgtatgcatgtatggatg

SEQ ID NO: 5575 - DNA, 19 bp, Arabidopsis thaliana
taagcacttgatcttgaac

SEQ ID NO: 5576 - DNA, 23 bp, Arabidopsis thaliana
aggtagagtgagtagatgtagat

SEQ ID NO: 5577 - DNA, 20 bp, Arabidopsis thaliana
tgttgctgttgatgatgatg

SEQ ID NO: 5578 - DNA, 18 bp, Arabidopsis thaliana
gagtgattttggtggttg

SEQ ID NO: 5579 - DNA, 21 bp, Arabidopsis thaliana
gaagagaagtctgtgattaga

SEQ ID NO: 5580 - DNA, 23 bp, Arabidopsis thaliana
ggtttgtacgtacactgttcatc

SEQ ID NO: 5581 - DNA, 19 bp, Arabidopsis thaliana
tactatctactgttcgttt

SEQ ID NO: 5582 - DNA, 18 bp, Arabidopsis thaliana
tttctgcaacacctctct

SEQ ID NO: 5583 - DNA, 18 bp, Arabidopsis thaliana
tgttcgcttttgatgaag

SEQ ID NO: 5584 - DNA, 22 bp, Arabidopsis thaliana
atgagtgtgcaaatgcttgttt

SEQ ID NO: 5585 - DNA, 20 bp, Arabidopsis thaliana
ttgttgatgatgatgatgat

SEQ ID NO: 5586 - DNA, 18 bp, Arabidopsis thaliana
ctgatgatgcagatctgg

SEQ ID NO: 5587 - DNA, 19 bp, Arabidopsis thaliana
agagccggagagattgaag

SEQ ID NO: 5588 - DNA, 19 bp, Arabidopsis thaliana
tctcatggaaaatctctct

SEQ ID NO: 5589 - DNA, 20 bp, Arabidopsis thaliana
aagtgtactgaaacagatga

SEQ ID NO: 5590 - DNA, 21 bp, Arabidopsis thaliana
acagaaagctgagagactcca

SEQ ID NO: 5591 - DNA, 21 bp, Arabidopsis thaliana
cgaaactggtgtcgaccgaca

SEQ ID NO: 5592 - DNA, 21 bp, Arabidopsis thaliana
atctccattgttgtcccattg

SEQ ID NO: 5593 - DNA, 18 bp, Arabidopsis thaliana
ttgttgttgatgtagctg

SEQ ID NO: 5594 - DNA, 21 bp, Arabidopsis thaliana
gggcagctgcaggtgtcgatc

SEQ ID NO: 5595 - DNA, 22 bp, Arabidopsis thaliana
tctctcttttgtgaattgtttt

SEQ ID NO: 5596 - DNA, 19 bp, Arabidopsis thaliana
aaactggtgtcgatcgaca

SEQ ID NO: 5597 - DNA, 18 bp, Arabidopsis thaliana
ttgttgttgatgtagctg

SEQ ID NO: 5598 - DNA, 20 bp, Arabidopsis thaliana
gagtgtgaattggtttgtga

SEQ ID NO: 5599 - DNA, 19 bp, Arabidopsis thaliana
tggttgtgacatgttgtag

SEQ ID NO: 5600 - DNA, 18 bp, Arabidopsis thaliana
tgaaccctggtggtggat

SEQ ID NO: 5601 - DNA, 20 bp, Arabidopsis thaliana
tgtgtgtgaatgtaagctag

SEQ ID NO: 5602 - DNA, 22 bp, Arabidopsis thaliana
ttgaattctgttgatgctgagt

SEQ ID NO: 5603 - DNA, 19 bp, Arabidopsis thaliana
gtccattgttgtcccattg

SEQ ID NO: 5604 - DNA, 19 bp, Arabidopsis thaliana
ttgagtgaacgctggtggt

SEQ ID NO: 5605 - DNA, 18 bp, Arabidopsis thaliana
tgattcgtagctgtgtga

SEQ ID NO: 5606 - DNA, 18 bp, Arabidopsis thaliana
ttgttgttgatgtagctg

SEQ ID NO: 5607 - DNA, 20 bp, Arabidopsis thaliana
attgaagtgatgatgtagtt

SEQ ID NO: 5608 - DNA, 20 bp, Arabidopsis thaliana
gtggtggcgtggatgctgct

SEQ ID NO: 5609 - DNA, 21 bp, Arabidopsis thaliana
ttgtgaatgctgtgagtgaca

SEQ ID NO: 5610 - DNA, 23 bp, Arabidopsis thaliana
tgtgactgtgtgactgtgtgact

SEQ ID NO: 5611 - DNA, 23 bp, Arabidopsis thaliana
tagagttcttcatcttgatcttg

SEQ ID NO: 5612 - DNA, 21 bp, Arabidopsis thaliana
cgaaactggtgtcgatcgaca

SEQ ID NO: 5613 - DNA, 20 bp, Arabidopsis thaliana
tgagacatgattcgattttg

SEQ ID NO: 5614 - DNA, 20 bp, Arabidopsis thaliana
ttcaatcagggagaagcagt

SEQ ID NO: 5615 - DNA, 23 bp, Arabidopsis thaliana
atgagttgggtctaacccataac

SEQ ID NO: 5616 - DNA, 23 bp, Arabidopsis thaliana
gaggttgatgatgatgaagaaga

SEQ ID NO: 5617 - DNA, 22 bp, Arabidopsis thaliana
ggacgtgtgtgtgtctctctct

SEQ ID NO: 5618 - DNA, 18 bp, Arabidopsis thaliana
tctccttcaacaggtgct

SEQ ID NO: 5619 - DNA, 21 bp, Arabidopsis thaliana
agcggcggcggcggcgatcgg

SEQ ID NO: 5620 - DNA, 20 bp, Arabidopsis thaliana
tagtatgatgatgatggtga

SEQ ID NO: 5621 - DNA, 23 bp, Arabidopsis thaliana
tgtgagcttggactttggagagt

SEQ ID NO: 5622 - DNA, 21 bp, Arabidopsis thaliana
aagctcgtgatgatgctggaa

SEQ ID NO: 5623 - DNA, 21 bp, Arabidopsis thaliana
tacttgagtcatgatttgcag

SEQ ID NO: 5624 - DNA, 20 bp, Arabidopsis thaliana
catcatcgtcttctgcttct

SEQ ID NO: 5625 - DNA, 21 bp, Arabidopsis thaliana
aacctggacacattggtttgt

SEQ ID NO: 5626 - DNA, 18 bp, Arabidopsis thaliana
tcttcctcctcctcatcg

SEQ ID NO: 5627 - DNA, 21 bp, Arabidopsis thaliana
tagttagatatatgttgttgg

SEQ ID NO: 5628 - DNA, 20 bp, Arabidopsis thaliana
tgaggttgttgtgtgaaagg

SEQ ID NO: 5629 - DNA, 19 bp, Arabidopsis thaliana
tacatcggtgtggttgtga

SEQ ID NO: 5630 - DNA, 23 bp, Arabidopsis thaliana
tttgattttcattgtagatctga

SEQ ID NO: 5631 - DNA, 18 bp, Arabidopsis thaliana
agctcaggtggtgttggg

SEQ ID NO: 5632 - DNA, 23 bp, Arabidopsis thaliana
tttggggacgagatgttttgttg

SEQ ID NO: 5633 - DNA, 18 bp, Arabidopsis thaliana
atgggagagattttgttg

SEQ ID NO: 5634 - DNA, 21 bp, Arabidopsis thaliana
atggacgcgttcaaggaggag

SEQ ID NO: 5635 - DNA, 20 bp, Arabidopsis thaliana
tcttccccatcttcctgctc

SEQ ID NO: 5636 - DNA, 19 bp, Arabidopsis thaliana
ccgttggtggcgctgttgg

SEQ ID NO: 5637 - DNA, 23 bp, Arabidopsis thaliana
agccgttggtggcgctgttggag

SEQ ID NO: 5638 - DNA, 18 bp, Arabidopsis thaliana
gcggtgctgggggtggtg

SEQ ID NO: 5639 - DNA, 23 bp, Arabidopsis thaliana
tagtgaatgataatgatgatgat

SEQ ID NO: 5640 - DNA, 20 bp, Arabidopsis thaliana
tgattggagaaactgatttg

SEQ ID NO: 5641 - DNA, 18 bp, Arabidopsis thaliana
tggtatcttctcttccat

SEQ ID NO: 5642 - DNA, 18 bp, Arabidopsis thaliana
atgtttatgcatcttaat

SEQ ID NO: 5643 - DNA, 19 bp, Arabidopsis thaliana
atatctcttgttgatctta

SEQ ID NO: 5644 - DNA, 20 bp, Arabidopsis thaliana
tgatgtgtgtcgacgtacgt

SEQ ID NO: 5645 - DNA, 22 bp, Arabidopsis thaliana
tttgatgaagcactgttgctgt

SEQ ID NO: 5646 - DNA, 19 bp, Arabidopsis thaliana
aaactcgtgttgttgttga

SEQ ID NO: 5647 - DNA, 19 bp, Arabidopsis thaliana
aaagtcttcttcttcttct

SEQ ID NO: 5648 - DNA, 21 bp, Arabidopsis thaliana
tcggaccaggcttcatccccc

SEQ ID NO: 5649 - DNA, 19 bp, Arabidopsis thaliana
actttgatgttgatgctga

SEQ ID NO: 5650 - DNA, 21 bp, Arabidopsis thaliana
tacgtgtgtgtgtgtgtgtgt

SEQ ID NO: 5651 - DNA, 23 bp, Arabidopsis thaliana
agccattgttgttgttgctgctg

SEQ ID NO: 5652 - DNA, 21 bp, Arabidopsis thaliana
agcctggtgttcttgttggtg

SEQ ID NO: 5653 - DNA, 21 bp, Arabidopsis thaliana
tgtgtgtttctctgtgtgcta

SEQ ID NO: 5654 - DNA, 20 bp, Arabidopsis thaliana
atgtggttggatgatgaact

SEQ ID NO: 5655 - DNA, 20 bp, Arabidopsis thaliana
tcaatggttttgatatgaag

SEQ ID NO: 5656 - DNA, 22 bp, Arabidopsis thaliana
tttccaaggtgtttgtgtgaga

SEQ ID NO: 5657 - DNA, 20 bp, Arabidopsis thaliana
ttcagagatgatgatgatga

SEQ ID NO: 5658 - DNA, 19 bp, Arabidopsis thaliana
atggttctttaatcttgta

SEQ ID NO: 5659 - DNA, 22 bp, Arabidopsis thaliana
tcatatgtttgtttttcttaga

SEQ ID NO: 5660 - DNA, 23 bp, Arabidopsis thaliana
tgtgtcagagagtgagagaaaga

SEQ ID NO: 5661 - DNA, 22 bp, Arabidopsis thaliana
aagctgttgttggagctctgaa

SEQ ID NO: 5662 - DNA, 22 bp, Arabidopsis thaliana
tcatcttcgtcatcatcaacgt

SEQ ID NO: 5663 - DNA, 22 bp, Arabidopsis thaliana
ttattcttcttcttcgagttct

SEQ ID NO: 5664 - DNA, 23 bp, Arabidopsis thaliana
aaggtgatgtctgtgtgtttgag

SEQ ID NO: 5665 - DNA, 22 bp, Arabidopsis thaliana
tattctgtgtgattttcaggca

SEQ ID NO: 5666 - DNA, 22 bp, Arabidopsis thaliana
atgttgattcttgcttctctga

SEQ ID NO: 5667 - DNA, 21 bp, Arabidopsis thaliana
ctttgctgttgttgatgtagt

SEQ ID NO: 5668 - DNA, 19 bp, Arabidopsis thaliana
tgttccttcatgttgctgt

SEQ ID NO: 5669 - DNA, 18 bp, Arabidopsis thaliana
gaggagcaggagcaggag

SEQ ID NO: 5670 - DNA, 23 bp, Arabidopsis thaliana
ctcgaagctcttctctgtgtgtg

SEQ ID NO: 5671 - DNA, 20 bp, Arabidopsis thaliana
tgagcttgtacatatatgtc

SEQ ID NO: 5672 - DNA, 22 bp, Arabidopsis thaliana
agagagtgagagacagagagag

SEQ ID NO: 5673 - DNA, 21 bp, Arabidopsis thaliana
tgacagaagagagtgagcaca

SEQ ID NO: 5674 - DNA, 21 bp, Arabidopsis thaliana
tcactgctctatctgtcagat

SEQ ID NO: 5675 - DNA, 20 bp, Arabidopsis thaliana
tgttcttgatggttgctggt

SEQ ID NO: 5676 - DNA, 19 bp, Arabidopsis thaliana
atgaagaagaagatggatt

SEQ ID NO: 5677 - DNA, 23 bp, Arabidopsis thaliana
acagtgatgatgatgatgatgaa

SEQ ID NO: 5678 - DNA, 19 bp, Arabidopsis thaliana
tgaagtgaggagcttgaat

SEQ ID NO: 5679 - DNA, 19 bp, Arabidopsis thaliana
aagtccgtccttgttttgc

SEQ ID NO: 5680 - DNA, 20 bp, Arabidopsis thaliana
agtgtgaattcatggttctg

SEQ ID NO: 5681 - DNA, 18 bp, Arabidopsis thaliana
tgaggaaggtgattgcag

SEQ ID NO: 5682 - DNA, 23 bp, Arabidopsis thaliana
actcaagctttgttgttgttggt

SEQ ID NO: 5683 - DNA, 21 bp, Arabidopsis thaliana
ttgatggagttgttgttgatg

SEQ ID NO: 5684 - DNA, 20 bp, Arabidopsis thaliana
aaactgtgaagttgatgaga

SEQ ID NO: 5685 - DNA, 18 bp, Arabidopsis thaliana
tagctttgttcatctaga

SEQ ID NO: 5686 - DNA, 19 bp, Arabidopsis thaliana
ttgcatggagtgtttgtga

SEQ ID NO: 5687 - DNA, 20 bp, Arabidopsis thaliana
tgacaatgatgatgatggac

SEQ ID NO: 5688 - DNA, 21 bp, Arabidopsis thaliana
tgtgtgcttattgtgtaagca

SEQ ID NO: 5689 - DNA, 23 bp, Arabidopsis thaliana
catcagatatgatgttgatgttg

SEQ ID NO: 5690 - DNA, 19 bp, Arabidopsis thaliana
tgtgctgtgtgcatgttga

SEQ ID NO: 5691 - DNA, 21 bp, Arabidopsis thaliana
tcacactgtagtttgttcgat

SEQ ID NO: 5692 - DNA, 19 bp, Arabidopsis thaliana
ttgccgcttccgctaccac

SEQ ID NO: 5693 - DNA, 19 bp, Arabidopsis thaliana
tgtggctcttctttgtgct

SEQ ID NO: 5694 - DNA, 18 bp, Arabidopsis thaliana
ttccttttctacctgata

SEQ ID NO: 5695 - DNA, 19 bp, Arabidopsis thaliana
atcttcatcatcatagaga

SEQ ID NO: 5696 - DNA, 20 bp, Arabidopsis thaliana
attgagtctggttttgtttc

SEQ ID NO: 5697 - DNA, 19 bp, Arabidopsis thaliana
tgattcttgatgtaagacc

SEQ ID NO: 5698 - DNA, 18 bp, Arabidopsis thaliana
aatcgaatggtgtttttg

SEQ ID NO: 5699 - DNA, 18 bp, Arabidopsis thaliana
tggtagatttcagctctt

SEQ ID NO: 5700 - DNA, 20 bp, Arabidopsis thaliana
atgatgatgatgaagatcat

SEQ ID NO: 5701 - DNA, 19 bp, Arabidopsis thaliana
atgggtgtgtatttgttct

SEQ ID NO: 5702 - DNA, 23 bp, Arabidopsis thaliana
taagattgagtgagtgtgtgtgt

SEQ ID NO: 5703 - DNA, 21 bp, Arabidopsis thaliana
tgatctctgtttgttcatctg

SEQ ID NO: 5704 - DNA, 21 bp, Arabidopsis thaliana
ttctctgttgatggtgtgctc

SEQ ID NO: 5705 - DNA, 21 bp, Arabidopsis thaliana
taactctgcttctgcttctca

SEQ ID NO: 5706 - DNA, 19 bp, Arabidopsis thaliana
ttttgcagtttcgtttcag

SEQ ID NO: 5707 - DNA, 23 bp, Arabidopsis thaliana
tgatcgacatcatcatcgtcgtc

SEQ ID NO: 5708 - DNA, 18 bp, Arabidopsis thaliana
agcttgaaagaagaattg

SEQ ID NO: 5709 - DNA, 18 bp, Arabidopsis thaliana
atgtttgtagatgaaggt

SEQ ID NO: 5710 - DNA, 19 bp, Arabidopsis thaliana
tcaggtacttctatgagct

SEQ ID NO: 5711 - DNA, 19 bp, Arabidopsis thaliana
tcgggtgtagttgggtttg

SEQ ID NO: 5712 - DNA, 20 bp, Arabidopsis thaliana
tcagcagcagcagcagcaac

SEQ ID NO: 5713 - DNA, 21 bp, Arabidopsis thaliana
aaggttgttgtttgaagatgc

SEQ ID NO: 5714 - DNA, 18 bp, Arabidopsis thaliana
actgctgtctcagctgct

SEQ ID NO: 5715 - DNA, 18 bp, Arabidopsis thaliana
gagggtgacatggattga

SEQ ID NO: 5716 - DNA, 18 bp, Arabidopsis thaliana
ttgtctagtgtagatgtg

SEQ ID NO: 5717 - DNA, 18 bp, Arabidopsis thaliana
gcctggtggggtggctgc

SEQ ID NO: 5718 - DNA, 20 bp, Arabidopsis thaliana
tattttgcagattcttcttc

SEQ ID NO: 5719 - DNA, 19 bp, Arabidopsis thaliana
gacagtgtggttagatggc

SEQ ID NO: 5720 - DNA, 23 bp, Arabidopsis thaliana
acagagttgatgttgctgtgcag

SEQ ID NO: 5721 - DNA, 20 bp, Arabidopsis thaliana
tctttgctcttctttgggtg

SEQ ID NO: 5722 - DNA, 23 bp, Arabidopsis thaliana
tcttatgtgatgttgatgttgct

SEQ ID NO: 5723 - DNA, 23 bp, Arabidopsis thaliana
tgattccacatgctttcttgaac

SEQ ID NO: 5724 - DNA, 18 bp, Arabidopsis thaliana
tgtgtgtgtgtctctcac

SEQ ID NO: 5725 - DNA, 21 bp, Arabidopsis thaliana
agtgtctgtgtgtgatggagt

SEQ ID NO: 5726 - DNA, 18 bp, Arabidopsis thaliana
tgtatggtagattaatgt

SEQ ID NO: 5727 - DNA, 19 bp, Arabidopsis thaliana
agtgtgagtgagagagagt

SEQ ID NO: 5728 - DNA, 22 bp, Arabidopsis thaliana
atgttcttcttcttcgtcgtca

SEQ ID NO: 5729 - DNA, 18 bp, Arabidopsis thaliana
tccggtggtgaggaagat

SEQ ID NO: 5730 - DNA, 18 bp, Arabidopsis thaliana
tctgtcgtcatcatcatc

SEQ ID NO: 5731 - DNA, 23 bp, Arabidopsis thaliana
ggctctgataccaattgatgcta

SEQ ID NO: 5732 - DNA, 22 bp, Arabidopsis thaliana
tcgctctgataccaaattgatg

SEQ ID NO: 5733 - DNA, 22 bp, Arabidopsis thaliana
tgagattgttgttgtaagtgct

SEQ ID NO: 5734 - DNA, 20 bp, Arabidopsis thaliana
atgagattcttgttgtagca

SEQ ID NO: 5735 - DNA, 21 bp, Arabidopsis thaliana
tttagttgttgttgatgctgt

SEQ ID NO: 5736 - DNA, 22 bp, Arabidopsis thaliana
tttgagcgtgtccatgtgcatc

SEQ ID NO: 5737 - DNA, 21 bp, Arabidopsis thaliana
tatcactcttttggtggtgtc

SEQ ID NO: 5738 - DNA, 21 bp, Arabidopsis thaliana
tcttgcctttgcatgtgcttg

SEQ ID NO: 5739 - DNA, 18 bp, Arabidopsis thaliana
acagtagaaactgagctc

SEQ ID NO: 5740 - DNA, 23 bp, Arabidopsis thaliana
aggtagtcagtgtttttgtttcg

SEQ ID NO: 5741 - DNA, 18 bp, Arabidopsis thaliana
tggttgcttctttgtgtg

SEQ ID NO: 5742 - DNA, 20 bp, Arabidopsis thaliana
tgctccttggcttttgactg

SEQ ID NO: 5743 - DNA, 19 bp, Arabidopsis thaliana
tgtgtttgtttatattggt

SEQ ID NO: 5744 - DNA, 21 bp, Arabidopsis thaliana
gagccaaggatgacttgccgg

SEQ ID NO: 5745 - DNA, 18 bp, Arabidopsis thaliana
gtggaaaaggaagcagaa

SEQ ID NO: 5746 - DNA, 20 bp, Arabidopsis thaliana
catgtttgatgcctttcttg

SEQ ID NO: 5747 - DNA, 20 bp, Arabidopsis thaliana
ttcagtctcaggatgatgat

SEQ ID NO: 5748 - DNA, 19 bp, Arabidopsis thaliana
attcttgttcttcgtcgtc

SEQ ID NO: 5749 - DNA, 23 bp, Arabidopsis thaliana
tgatagtgattgttcttgttgga

SEQ ID NO: 5750 - DNA, 18 bp, Arabidopsis thaliana
tgtgctacatctttgatg

SEQ ID NO: 5751 - DNA, 21 bp, Arabidopsis thaliana
ttttgattgttgaagttctat

SEQ ID NO: 5752 - DNA, 18 bp, Arabidopsis thaliana
tgctgctgatgctgctgc

SEQ ID NO: 5753 - DNA, 21 bp, Arabidopsis thaliana
ttgttggagatgttcttgatc

SEQ ID NO: 5754 - DNA, 23 bp, Arabidopsis thaliana
catctttgttcttgatgtagatg

SEQ ID NO: 5755 - DNA, 23 bp, Arabidopsis thaliana
ctttgttcttcttcttcaagaac

SEQ ID NO: 5756 - DNA, 23 bp, Arabidopsis thaliana
tacatgaacatgtttgttgttga

SEQ ID NO: 5757 - DNA, 18 bp, Arabidopsis thaliana
tacaggcacgtgtgtgtg

SEQ ID NO: 5758 - DNA, 20 bp, Arabidopsis thaliana
agtctgtgagaggtggtttt

SEQ ID NO: 5759 - DNA, 23 bp, Arabidopsis thaliana
cttgagactctctctgaagttgt

SEQ ID NO: 5760 - DNA, 19 bp, Arabidopsis thaliana
agaaagagagagactgtgt

SEQ ID NO: 5761 - DNA, 20 bp, Arabidopsis thaliana
tgcttctctcattttgtagt

SEQ ID NO: 5762 - DNA, 19 bp, Arabidopsis thaliana
atctgatgatgctctcact

SEQ ID NO: 5763 - DNA, 18 bp, Arabidopsis thaliana
tagacttttgttttggta

SEQ ID NO: 5764 - DNA, 18 bp, Arabidopsis thaliana
taggtgtagtttcttcat

SEQ ID NO: 5765 - DNA, 19 bp, Arabidopsis thaliana
atggttgatgattcttcat

SEQ ID NO: 5766 - DNA, 23 bp, Arabidopsis thaliana
tccatgatgatgatgaagaagaa

SEQ ID NO: 5767 - DNA, 22 bp, Arabidopsis thaliana
atgatcatgatcaagatggtga

SEQ ID NO: 5768 - DNA, 23 bp, Arabidopsis thaliana
aagacgaagatgatgatgaagaa

SEQ ID NO: 5769 - DNA, 21 bp, Arabidopsis thaliana
atttcttcctgttgatgttct

SEQ ID NO: 5770 - DNA, 19 bp, Arabidopsis thaliana
acacagtgcttttgatgac

SEQ ID NO: 5771 - DNA, 20 bp, Arabidopsis thaliana
tgtgaatgattttgttggaa

SEQ ID NO: 5772 - DNA, 21 bp, Arabidopsis thaliana
tgactgtcagctttgatgtgt

SEQ ID NO: 5773 - DNA, 18 bp, Arabidopsis thaliana
aagttttagattcttctt

SEQ ID NO: 5774 - DNA, 22 bp, Arabidopsis thaliana
tgacactcatcatcatcgtgat

SEQ ID NO: 5775 - DNA, 21 bp, Arabidopsis thaliana
ttgtgttctctatttcttctg

SEQ ID NO: 5776 - DNA, 21 bp, Arabidopsis thaliana
tctgtctctgtgtgcgtgcat

SEQ ID NO: 5777 - DNA, 23 bp, Arabidopsis thaliana
ttgtatgctgtggatgaagattg

SEQ ID NO: 5778 - DNA, 19 bp, Arabidopsis thaliana
tcttcttctacttctagct

SEQ ID NO: 5779 - DNA, 21 bp, Arabidopsis thaliana
tggatctgcagcagcatcagg

SEQ ID NO: 5780 - DNA, 21 bp, Arabidopsis thaliana
ggctgctgttgccatagctgc

SEQ ID NO: 5781 - DNA, 20 bp, Arabidopsis thaliana
tctctatctccatctctcac

SEQ ID NO: 5782 - DNA, 21 bp, Arabidopsis thaliana
attcttctatttcttcgtctt

SEQ ID NO: 5783 - DNA, 21 bp, Arabidopsis thaliana
tctgcttcatcttcttcctca

SEQ ID NO: 5784 - DNA, 18 bp, Arabidopsis thaliana
ctctctttctctctccct

SEQ ID NO: 5785 - DNA, 21 bp, Arabidopsis thaliana
agtgttgaactttgtgtctgt

SEQ ID NO: 5786 - DNA, 19 bp, Arabidopsis thaliana
aacttcatcatcttcttgt

SEQ ID NO: 5787 - DNA, 19 bp, Arabidopsis thaliana
tttcttctttctcttgttg

SEQ ID NO: 5788 - DNA, 19 bp, Arabidopsis thaliana
tgttggattggtggagcag

SEQ ID NO: 5789 - DNA, 20 bp, Arabidopsis thaliana
tacattatcttggatgttgt

SEQ ID NO: 5790 - DNA, 22 bp, Arabidopsis thaliana
tttgtgtgtgtatatgatcact

SEQ ID NO: 5791 - DNA, 19 bp, Arabidopsis thaliana
atgctttgatattgatggt

SEQ ID NO: 5792 - DNA, 23 bp, Arabidopsis thaliana
gtctttggttaagtttctgttgt

SEQ ID NO: 5793 - DNA, 20 bp, Arabidopsis thaliana
tttgtgtcttgttcatctta

SEQ ID NO: 5794 - DNA, 21 bp, Arabidopsis thaliana
tgtggatgtatcttggtggtt

SEQ ID NO: 5795 - DNA, 18 bp, Arabidopsis thaliana
ttcttcttctactacttc

SEQ ID NO: 5796 - DNA, 21 bp, Arabidopsis thaliana
ctctgatttgtctatctgttg

SEQ ID NO: 5797 - DNA, 22 bp, Arabidopsis thaliana
tcacagtggtgatgttggtgat

SEQ ID NO: 5798 - DNA, 21 bp, Arabidopsis thaliana
agtttgtgttcttttgatgtt

SEQ ID NO: 5799 - DNA, 18 bp, Arabidopsis thaliana
tctgagcgagagtacctg

SEQ ID NO: 5800 - DNA, 18 bp, Arabidopsis thaliana
atgatgatgatgatgatg

SEQ ID NO: 5801 - DNA, 18 bp, Arabidopsis thaliana
agctgaagctttgtagga

SEQ ID NO: 5802 - DNA, 18 bp, Arabidopsis thaliana
gttatgtatgatattata

SEQ ID NO: 5803 - DNA, 20 bp, Arabidopsis thaliana
ttgtcagttattcttggttt

SEQ ID NO: 5804 - DNA, 20 bp, Arabidopsis thaliana
ttgtcagttattcttggttt

SEQ ID NO: 5805 - DNA, 20 bp, Arabidopsis thaliana
aaggctttgctgaaactctg

SEQ ID NO: 5806 - DNA, 19 bp, Arabidopsis thaliana
tcagtggcttttgattaag

SEQ ID NO: 5807 - DNA, 18 bp, Arabidopsis thaliana
tttcttgttgattttgca

SEQ ID NO: 5808 - DNA, 23 bp, Arabidopsis thaliana
tgattgtgattgtgctagagtgt

SEQ ID NO: 5809 - DNA, 19 bp, Arabidopsis thaliana
tgtcaagtgtaattgttct

SEQ ID NO: 5810 - DNA, 19 bp, Arabidopsis thaliana
tgagatcgttcacttgaag

SEQ ID NO: 5811 - DNA, 18 bp, Arabidopsis thaliana
agctgtgttggtcaagtg

SEQ ID NO: 5812 - DNA, 18 bp, Arabidopsis thaliana
aactccttggttcttctt

SEQ ID NO: 5813 - DNA, 21 bp, Arabidopsis thaliana
cgaaactggtgtcgatcgaca

SEQ ID NO: 5814 - DNA, 18 bp, Arabidopsis thaliana
tcatgatgatcatcatca

SEQ ID NO: 5815 - DNA, 21 bp, Arabidopsis thaliana
tctttcattgttgcatgtgct

SEQ ID NO: 5816 - DNA, 18 bp, Arabidopsis thaliana
ctgtgttcttttggaggg

SEQ ID NO: 5817 - DNA, 22 bp, Arabidopsis thaliana
aagatgaagaacaagtagatga

SEQ ID NO: 5818 - DNA, 22 bp, Arabidopsis thaliana
attgtgagtgttgatcgacata

SEQ ID NO: 5819 - DNA, 19 bp, Arabidopsis thaliana
gttcttcttcttcctcgac

SEQ ID NO: 5820 - DNA, 18 bp, Arabidopsis thaliana
tgttgttgcaggtgacga

SEQ ID NO: 5821 - DNA, 19 bp, Arabidopsis thaliana
ctggatcttgagctgctgg

SEQ ID NO: 5822 - DNA, 19 bp, Arabidopsis thaliana
tgaaccctggtggtggatt

SEQ ID NO: 5823 - DNA, 20 bp, Arabidopsis thaliana
atcaatctgcttcttcttct

SEQ ID NO: 5824 - DNA, 19 bp, Arabidopsis thaliana
agtctttggctttgtgtct

SEQ ID NO: 5825 - DNA, 19 bp, Arabidopsis thaliana
agtctttggctttgtgtct

SEQ ID NO: 5826 - DNA, 20 bp, Arabidopsis thaliana
acaaatgctggttcttgctc

SEQ ID NO: 5827 - DNA, 23 bp, Arabidopsis thaliana
agcctgtgactggttatgttgac

SEQ ID NO: 5828 - DNA, 18 bp, Arabidopsis thaliana
ttgttgttgatgtagctg

SEQ ID NO: 5829 - DNA, 18 bp, Arabidopsis thaliana
ttgttgttgatgtagctg

SEQ ID NO: 5830 - DNA, 22 bp, Arabidopsis thaliana
ttgtccttggagaatctgctgt

SEQ ID NO: 5831 - DNA, 21 bp, Arabidopsis thaliana
tgattgttgttgatgtagctg

SEQ ID NO: 5832 - DNA, 18 bp, Arabidopsis thaliana
actgttgatgatggtcca

SEQ ID NO: 5833 - DNA, 20 bp, Arabidopsis thaliana
aagcaggtggtgatggtggt

SEQ ID NO: 5834 - DNA, 23 bp, Arabidopsis thaliana
agagatgatgttcgtgctgagtt

SEQ ID NO: 5835 - DNA, 19 bp, Arabidopsis thaliana
tctagccactctcttcttc

SEQ ID NO: 5836 - DNA, 20 bp, Arabidopsis thaliana
tgattgtcatagctgtttgt

SEQ ID NO: 5837 - DNA, 19 bp, Arabidopsis thaliana
tgttatgtatgatattata

SEQ ID NO: 5838 - DNA, 19 bp, Arabidopsis thaliana
tagctcatcttggtcatag

SEQ ID NO: 5839 - DNA, 23 bp, Arabidopsis thaliana
ttgtgtgtgtctctctctctctc

SEQ ID NO: 5840 - DNA, 19 bp, Arabidopsis thaliana
ttaaatcatattcttgttg

SEQ ID NO: 5841 - DNA, 23 bp, Arabidopsis thaliana
agtgtgagagagagagagattca

SEQ ID NO: 5842 - DNA, 18 bp, Arabidopsis thaliana
ttgttgttgatgtagctg

SEQ ID NO: 5843 - DNA, 23 bp, Arabidopsis thaliana
tgtgtttgctttgttggttgatg

SEQ ID NO: 5844 - DNA, 20 bp, Arabidopsis thaliana
tatgcattgcatgttttggt

SEQ ID NO: 5845 - DNA, 19 bp, Arabidopsis thaliana
aatggatgatgttgatgat

SEQ ID NO: 5846 - DNA, 21 bp, Arabidopsis thaliana
atttcttctacaaagttgttt

SEQ ID NO: 5847 - DNA, 18 bp, Arabidopsis thaliana
taccatgcatttgttctc

SEQ ID NO: 5848 - DNA, 20 bp, Arabidopsis thaliana
acctggtgaagatagtgaag

SEQ ID NO: 5849 - DNA, 23 bp, Arabidopsis thaliana
ttatcatcttgtttgttcaatga

SEQ ID NO: 5850 - DNA, 23 bp, Arabidopsis thaliana
atcgtcagtgcttttgttgatct

SEQ ID NO: 5851 - DNA, 18 bp, Arabidopsis thaliana
tctttgtgaagaagatga

SEQ ID NO: 5852 - DNA, 20 bp, Arabidopsis thaliana
tacttttcttttgatgttgg

SEQ ID NO: 5853 - DNA, 21 bp, Arabidopsis thaliana
tgtggttgttggatgaagaga

SEQ ID NO: 5854 - DNA, 19 bp, Arabidopsis thaliana
tcaagtgtgtggttgtggt

SEQ ID NO: 5855 - DNA, 21 bp, Arabidopsis thaliana
aagagagttgttcttcttctt

SEQ ID NO: 5856 - DNA, 21 bp, Arabidopsis thaliana
tctggtaactttttttgtgtg

SEQ ID NO: 5857 - DNA, 18 bp, Arabidopsis thaliana
tacaaaagcttggagtag

SEQ ID NO: 5858 - DNA, 20 bp, Arabidopsis thaliana
tgtccaccaatcttttagtg

SEQ ID NO: 5859 - DNA, 18 bp, Arabidopsis thaliana
tgtctattttggatgatg

SEQ ID NO: 5860 - DNA, 19 bp, Arabidopsis thaliana
tttgctgtgtttgttgagg

SEQ ID NO: 5861 - DNA, 20 bp, Arabidopsis thaliana
atgcattggaggttgatttt

SEQ ID NO: 5862 - DNA, 18 bp, Arabidopsis thaliana
ttctcttcatgctcgtcg

SEQ ID NO: 5863 - DNA, 19 bp, Arabidopsis thaliana
tgcagtgttgttgctttgg

SEQ ID NO: 5864 - DNA, 20 bp, Arabidopsis thaliana
agctgctggtgttgatgctg

SEQ ID NO: 5865 - DNA, 21 bp, Arabidopsis thaliana
taatcttcatgttgatgctga

SEQ ID NO: 5866 - DNA, 18 bp, Arabidopsis thaliana
aggttcctagctcggtgt

SEQ ID NO: 5867 - DNA, 18 bp, Arabidopsis thaliana
gatgtgaatgtgcatgta

SEQ ID NO: 5868 - DNA, 19 bp, Arabidopsis thaliana
tgattctctaactaatgag

SEQ ID NO: 5869 - DNA, 22 bp, Arabidopsis thaliana
agaacaagaagaagatgatggt

SEQ ID NO: 5870 - DNA, 18 bp, Arabidopsis thaliana
agagtgagagggagagag

SEQ ID NO: 5871 - DNA, 20 bp, Arabidopsis thaliana
tttgtgtgttgatcttgatt

SEQ ID NO: 5872 - DNA, 23 bp, Arabidopsis thaliana
tgtgtaacgttatgttgctgcaa

SEQ ID NO: 5873 - DNA, 18 bp, Arabidopsis thaliana
tcatctggtgattggtgt

SEQ ID NO: 5874 - DNA, 18 bp, Arabidopsis thaliana
ttatggtggacctagtgg

SEQ ID NO: 5875 - DNA, 23 bp, Arabidopsis thaliana
tgcaagagaggtctctatgttgt

SEQ ID NO: 5876 - DNA, 18 bp, Arabidopsis thaliana
caaggttctgcttctttg

SEQ ID NO: 5877 - DNA, 23 bp, Arabidopsis thaliana
tttgtgcttcttcatctgtctct

SEQ ID NO: 5878 - DNA, 21 bp, Arabidopsis thaliana
tgatgttgatgatgttgctgt

SEQ ID NO: 5879 - DNA, 18 bp, Arabidopsis thaliana
agaaactccttgcttctg

SEQ ID NO: 5880 - DNA, 22 bp, Arabidopsis thaliana
atcatcatcatcatcatcatca

SEQ ID NO: 5881 - DNA, 18 bp, Arabidopsis thaliana
atgatgatgatgatgatg

SEQ ID NO: 5882 - DNA, 18 bp, Arabidopsis thaliana
atgcatgatgatgatgtt

SEQ ID NO: 5883 - DNA, 23 bp, Arabidopsis thaliana
atttgtctgtgtttgtgaatctg

SEQ ID NO: 5884 - DNA, 20 bp, Arabidopsis thaliana
agtgcttgatgttggaggtg

SEQ ID NO: 5885 - DNA, 19 bp, Arabidopsis thaliana
agcagctctgtatattagg

SEQ ID NO: 5886 - DNA, 20 bp, Arabidopsis thaliana
tgagcagtgattcttttcag

SEQ ID NO: 5887 - DNA, 18 bp, Arabidopsis thaliana
tatattttatatatttgg

SEQ ID NO: 5888 - DNA, 19 bp, Arabidopsis thaliana
gaggtcaaggaggtgctgg

SEQ ID NO: 5889 - DNA, 22 bp, Arabidopsis thaliana
cgtgtgtgtggaagagagaggg

SEQ ID NO: 5890 - DNA, 21 bp, Arabidopsis thaliana
agttggtgatgcgtttgtttc

SEQ ID NO: 5891 - DNA, 20 bp, Arabidopsis thaliana
tgaaagtgcatcaagcagta

SEQ ID NO: 5892 - DNA, 20 bp, Arabidopsis thaliana
agtggaatgatgttgctgtt

SEQ ID NO: 5893 - DNA, 22 bp, Arabidopsis thaliana
tgaagctggtgatgaagaaggt

SEQ ID NO: 5894 - DNA, 18 bp, Arabidopsis thaliana
gagagagagagagagaga

SEQ ID NO: 5895 - DNA, 21 bp, Arabidopsis thaliana
actctatttgtgattgtgtgt

SEQ ID NO: 5896 - DNA, 21 bp, Arabidopsis thaliana
ttatcttcatcttcttcctcg

SEQ ID NO: 5897 - DNA, 18 bp, Arabidopsis thaliana
cgacgggccgcgcgcggg

SEQ ID NO: 5898 - DNA, 23 bp, Arabidopsis thaliana
gtaagtgtttcactttgctgctt

SEQ ID NO: 5899 - DNA, 23 bp, Arabidopsis thaliana
atatgtgtgtgtgtgtgtgaatc

SEQ ID NO: 5900 - DNA, 21 bp, Arabidopsis thaliana
tcggaccaggcttcattcccc

SEQ ID NO: 5901 - DNA, 19 bp, Arabidopsis thaliana
gaatcttgatgatcgtcga

SEQ ID NO: 5902 - DNA, 19 bp, Arabidopsis thaliana
gtgagagtgagaaaatgtg

SEQ ID NO: 5903 - DNA, 19 bp, Arabidopsis thaliana
ggtttgggttcggattgat

SEQ ID NO: 5904 - DNA, 23 bp, Arabidopsis thaliana
atggttgtgtgtggttgtcatga

SEQ ID NO: 5905 - DNA, 20 bp, Arabidopsis thaliana
agagagcatgcattgttgac

SEQ ID NO: 5906 - DNA, 18 bp, Arabidopsis thaliana
tcagatttgatgaagatg

SEQ ID NO: 5907 - DNA, 21 bp, Arabidopsis thaliana
atgtgtgtgaggatctttatg

SEQ ID NO: 5908 - DNA, 21 bp, Arabidopsis thaliana
tgtgttaactcatactgcact

SEQ ID NO: 5909 - DNA, 23 bp, Arabidopsis thaliana
tagtactgtgttcttctttctct

SEQ ID NO: 5910 - DNA, 19 bp, Arabidopsis thaliana
aagaagtctgttgcagctc

SEQ ID NO: 5911 - DNA, 22 bp, Arabidopsis thaliana
tatgtatgtgtagatgtgtttg

SEQ ID NO: 5912 - DNA, 18 bp, Arabidopsis thaliana
ctttgtggatgacacgtg

SEQ ID NO: 5913 - DNA, 18 bp, Arabidopsis thaliana
tggatcatgatgcagctg

SEQ ID NO: 5914 - DNA, 19 bp, Arabidopsis thaliana
tgtgttcttgttgaaatct

SEQ ID NO: 5915 - DNA, 20 bp, Arabidopsis thaliana
tttcatgtatcctgtaggag

SEQ ID NO: 5916 - DNA, 23 bp, Arabidopsis thaliana
agagagaagagttgatgatgatc

SEQ ID NO: 5917 - DNA, 20 bp, Arabidopsis thaliana
agtgtgagagtcagagtgag

SEQ ID NO: 5918 - DNA, 18 bp, Arabidopsis thaliana
agtggttttcaaagagat

SEQ ID NO: 5919 - DNA, 20 bp, Arabidopsis thaliana
tcaaggaactgcaagaaatg

SEQ ID NO: 5920 - DNA, 23 bp, Arabidopsis thaliana
ctatgtgtatcagtgtatgtgtg

SEQ ID NO: 5921 - DNA, 21 bp, Arabidopsis thaliana
agtttctttctgtgtgtatgt

SEQ ID NO: 5922 - DNA, 19 bp, Arabidopsis thaliana
aaagagcattgagtatctg

SEQ ID NO: 5923 - DNA, 18 bp, Arabidopsis thaliana
tatgtctacatcttcatg

SEQ ID NO: 5924 - DNA, 23 bp, Arabidopsis thaliana
ctctctctgcttttgtattcctt

SEQ ID NO: 5925 - DNA, 20 bp, Arabidopsis thaliana
tggagcaattctagtttatg

SEQ ID NO: 5926 - DNA, 19 bp, Arabidopsis thaliana
tgagactttgttagttgtt

SEQ ID NO: 5927 - DNA, 18 bp, Arabidopsis thaliana
gacgagctgctgctgctg

SEQ ID NO: 5928 - DNA, 22 bp, Arabidopsis thaliana
atgaagatgaagatgaaggtga

SEQ ID NO: 5929 - DNA, 18 bp, Arabidopsis thaliana
agagagctttgctttgca

SEQ ID NO: 5930 - DNA, 21 bp, Arabidopsis thaliana
aggtgatgcagagctggagct

SEQ ID NO: 5931 - DNA, 23 bp, Arabidopsis thaliana
tgatgatgaagatgaagaagaag

SEQ ID NO: 5932 - DNA, 23 bp, Arabidopsis thaliana
tctgtgtgtgtgtctctctctct

SEQ ID NO: 5933 - DNA, 20 bp, Arabidopsis thaliana
aggaatgtatggatgtgaat

SEQ ID NO: 5934 - DNA, 23 bp, Arabidopsis thaliana
aagaactgtgtggttgtgcagtg

SEQ ID NO: 5935 - DNA, 23 bp, Arabidopsis thaliana
tatgcttggtttttgtggatgta

SEQ ID NO: 5936 - DNA, 20 bp, Arabidopsis thaliana
tcacagatgatgatgatgat

SEQ ID NO: 5937 - DNA, 21 bp, Arabidopsis thaliana
ttggcattgttgttgttgtaa

SEQ ID NO: 5938 - DNA, 18 bp, Arabidopsis thaliana
gcttcttcttctttgtgt

SEQ ID NO: 5939 - DNA, 19 bp, Arabidopsis thaliana
ggagctgttgctgctgctg

SEQ ID NO: 5940 - DNA, 22 bp, Arabidopsis thaliana
tgtttgattcaagttcttgatg

SEQ ID NO: 5941 - DNA, 21 bp, Arabidopsis thaliana
tgaggcagattgcattgcagt

SEQ ID NO: 5942 - DNA, 19 bp, Arabidopsis thaliana
ttcgactcaagagagctgc

SEQ ID NO: 5943 - DNA, 21 bp, Arabidopsis thaliana
tgatggtgttggtctcatgta

SEQ ID NO: 5944 - DNA, 23 bp, Arabidopsis thaliana
tcaggatgatgatgatgatgatg

SEQ ID NO: 5945 - DNA, 23 bp, Arabidopsis thaliana
tcaggatgatgatgatgatgatg

SEQ ID NO: 5946 - DNA, 23 bp, Arabidopsis thaliana
atgagttgggtctaacccataac

SEQ ID NO: 5947 - DNA, 18 bp, Arabidopsis thaliana
aaatgcatgcattttgaa

SEQ ID NO: 5948 - DNA, 22 bp, Arabidopsis thaliana
attggtctttggagagtctaag

SEQ ID NO: 5949 - DNA, 20 bp, Arabidopsis thaliana
tctcttggtgtgcacctgca

SEQ ID NO: 5950 - DNA, 21 bp, Arabidopsis thaliana
agtatgtcaatgtgtgtgtgt

SEQ ID NO: 5951 - DNA, 18 bp, Arabidopsis thaliana
atgaatcatctggatgaa

SEQ ID NO: 5952 - DNA, 23 bp, Arabidopsis thaliana
tcgtgatcatcatcatcgtcatc

SEQ ID NO: 5953 - DNA, 21 bp, Arabidopsis thaliana
acactcattgcatttgtgaac

SEQ ID NO: 5954 - DNA, 23 bp, Arabidopsis thaliana
tttgcatgtgtgtttgagtgtgt

SEQ ID NO: 5955 - DNA, 20 bp, Arabidopsis thaliana
tggcaatgcatttgtgtgtt

SEQ ID NO: 5956 - DNA, 23 bp, Arabidopsis thaliana
tggtgttgatgttgcagagctgg

SEQ ID NO: 5957 - DNA, 23 bp, Arabidopsis thaliana
tgtgtgagagagagagagagtca

SEQ ID NO: 5958 - DNA, 23 bp, Arabidopsis thaliana
gacagtagatttgtttggtttta

SEQ ID NO: 5959 - DNA, 23 bp, Arabidopsis thaliana
tctctgtctgtctttgtccctct

SEQ ID NO: 5960 - DNA, 18 bp, Arabidopsis thaliana
ttggtctagtctgggact

SEQ ID NO: 5961 - DNA, 21 bp, Arabidopsis thaliana
agcaactgattggatgttgtt

SEQ ID NO: 5962 - DNA, 21 bp, Arabidopsis thaliana
tgaggatgaagactgtgttgt

SEQ ID NO: 5963 - DNA, 19 bp, Arabidopsis thaliana
ctattgttaagatgtttga

SEQ ID NO: 5964 - DNA, 18 bp, Arabidopsis thaliana
atgtaggctcaccttgta

SEQ ID NO: 5965 - DNA, 20 bp, Arabidopsis thaliana
tcttcgtcatcatctccgtg

SEQ ID NO: 5966 - DNA, 19 bp, Arabidopsis thaliana
tgtggttgtttggattgct

SEQ ID NO: 5967 - DNA, 18 bp, Arabidopsis thaliana
agatcatcatcatcaatc

SEQ ID NO: 5968 - DNA, 21 bp, Arabidopsis thaliana
tgtgtgtgttttcagatgagt

SEQ ID NO: 5969 - DNA, 23 bp, Arabidopsis thaliana
aaatgatgatgatcattcttcat

SEQ ID NO: 5970 - DNA, 18 bp, Arabidopsis thaliana
tgtcttttgtgtttgtgt

SEQ ID NO: 5971 - DNA, 21 bp, Arabidopsis thaliana
tgtgatgcaggttcttcttct

SEQ ID NO: 5972 - DNA, 20 bp, Arabidopsis thaliana
tggttggatcgttgacaggt

SEQ ID NO: 5973 - DNA, 23 bp, Arabidopsis thaliana
ttagtctgtgtctatgtctcttc

SEQ ID NO: 5974 - DNA, 19 bp, Arabidopsis thaliana
tctggattcttgctgtaca

SEQ ID NO: 5975 - DNA, 18 bp, Arabidopsis thaliana
acgaacatgatgatgatg

SEQ ID NO: 5976 - DNA, 22 bp, Arabidopsis thaliana
tgcttgtgagtattgtttgttt

SEQ ID NO: 5977 - DNA, 19 bp, Arabidopsis thaliana
tgttctcttggttgtcttg

SEQ ID NO: 5978 - DNA, 19 bp, Arabidopsis thaliana
tagccattgtcttcctagg

SEQ ID NO: 5979 - DNA, 20 bp, Arabidopsis thaliana
tctgattgttcttgatggga

SEQ ID NO: 5980 - DNA, 20 bp, Arabidopsis thaliana
ttggaacgaattgatttgat

SEQ ID NO: 5981 - DNA, 18 bp, Arabidopsis thaliana
agagtagaagctgatgag

SEQ ID NO: 5982 - DNA, 18 bp, Arabidopsis thaliana
atgtgtgccgtgctgtga

SEQ ID NO: 5983 - DNA, 21 bp, Arabidopsis thaliana
tgaggttgttcttgtctgagt

SEQ ID NO: 5984 - DNA, 22 bp, Arabidopsis thaliana
tggtcattgctctggacctagg

SEQ ID NO: 5985 - DNA, 23 bp, Arabidopsis thaliana
gctcctcttcttgttcatggtca

SEQ ID NO: 5986 - DNA, 21 bp, Arabidopsis thaliana
ttcagaattgatcatcttcta

SEQ ID NO: 5987 - DNA, 19 bp, Arabidopsis thaliana
gtgctctctttcttctgtc

SEQ ID NO: 5988 - DNA, 23 bp, Arabidopsis thaliana
aacttgtttgatcttcttcctca

SEQ ID NO: 5989 - DNA, 18 bp, Arabidopsis thaliana
ttggttttgaaactgatg

SEQ ID NO: 5990 - DNA, 21 bp, Arabidopsis thaliana
tgagtctctgtctctctccga

SEQ ID NO: 5991 - DNA, 23 bp, Arabidopsis thaliana
ttcatcatcatcatcatctctgt

SEQ ID NO: 5992 - DNA, 23 bp, Arabidopsis thaliana
attacaatggtgatgatcttgaa

SEQ ID NO: 5993 - DNA, 21 bp, Arabidopsis thaliana
tctgagcttggtttttgtgtg

SEQ ID NO: 5994 - DNA, 22 bp, Arabidopsis thaliana
ttttctctgtgcatgtgtctga

SEQ ID NO: 5995 - DNA, 18 bp, Arabidopsis thaliana
gtgagatcatttgttgca

SEQ ID NO: 5996 - DNA, 19 bp, Arabidopsis thaliana
tgagagaggtaatgttgta

SEQ ID NO: 5997 - DNA, 21 bp, Arabidopsis thaliana
ttgtgttttgtgcatctgttc

SEQ ID NO: 5998 - DNA, 22 bp, Arabidopsis thaliana
tgtgacagattgatttgtgtga

SEQ ID NO: 5999 - DNA, 19 bp, Arabidopsis thaliana
gtcagctggacatgctctt

SEQ ID NO: 6000 - DNA, 18 bp, Arabidopsis thaliana
tgtcaattgatattgttg

SEQ ID NO: 6001 - DNA, 23 bp, Arabidopsis thaliana
agggtctctctgtgtgtgtgggg

SEQ ID NO: 6002 - DNA, 21 bp, Arabidopsis thaliana
tgtgatgaacatttatgatga

SEQ ID NO: 6003 - DNA, 20 bp, Arabidopsis thaliana
gtgtgtcgttttgcatgtgt

SEQ ID NO: 6004 - DNA, 19 bp, Arabidopsis thaliana
gtaagacgatcaaaatgtt

SEQ ID NO: 6005 - DNA, 21 bp, Arabidopsis thaliana
cctctcaaagccattgttgct

SEQ ID NO: 6006 - DNA, 23 bp, Arabidopsis thaliana
tatgtgagagtctttgagtgtga

SEQ ID NO: 6007 - DNA, 19 bp, Arabidopsis thaliana
acttgatcaaaatagtagt

SEQ ID NO: 6008 - DNA, 23 bp, Arabidopsis thaliana
tgaaagtggttctcaatgcatca

SEQ ID NO: 6009 - DNA, 20 bp, Arabidopsis thaliana
tcagagagagatagagagtc

SEQ ID NO: 6010 - DNA, 21 bp, Arabidopsis thaliana
aaattcctcagtttcatttgg

SEQ ID NO: 6011 - DNA, 23 bp, Arabidopsis thaliana
agcagctccagcagcaggcgcag

SEQ ID NO: 6012 - DNA, 19 bp, Arabidopsis thaliana
ttctctctgtttttgttgt

SEQ ID NO: 6013 - DNA, 19 bp, Arabidopsis thaliana
tctctgtgacagggacaga

SEQ ID NO: 6014 - DNA, 22 bp, Arabidopsis thaliana
acatcatcatcatgatcatcat

SEQ ID NO: 6015 - DNA, 18 bp, Arabidopsis thaliana
agcggcaggtgcagcagg

SEQ ID NO: 6016 - DNA, 19 bp, Arabidopsis thaliana
tactgactttgatacttgt

SEQ ID NO: 6017 - DNA, 20 bp, Arabidopsis thaliana
aattcatcttcatcttcctg

SEQ ID NO: 6018 - DNA, 20 bp, Arabidopsis thaliana
gaatcttgatgatgctgcat

SEQ ID NO: 6019 - DNA, 19 bp, Arabidopsis thaliana
tctcaaccaattatgatga

SEQ ID NO: 6020 - DNA, 20 bp, Arabidopsis thaliana
aactgttttgtttcagtaca

SEQ ID NO: 6021 - DNA, 21 bp, Arabidopsis thaliana
ttcgcaggagagatagcgcca

SEQ ID NO: 6022 - DNA, 23 bp, Arabidopsis thaliana
tctccttcttcatcgtcatcgtc

SEQ ID NO: 6023 - DNA, 19 bp, Arabidopsis thaliana
aagtattctggttctggtc

SEQ ID NO: 6024 - DNA, 23 bp, Arabidopsis thaliana
ctgtgtgtgtatgtgtgactgtg

SEQ ID NO: 6025 - DNA, 19 bp, Arabidopsis thaliana
tgtgctttgtttctgcaga

SEQ ID NO: 6026 - DNA, 23 bp, Arabidopsis thaliana
taattcttgatgatgatgcagca

SEQ ID NO: 6027 - DNA, 20 bp, Arabidopsis thaliana
ggctgtgagcaacgtgtgtg

SEQ ID NO: 6028 - DNA, 21 bp, Arabidopsis thaliana
tcttgaatatgctttgcagct

SEQ ID NO: 6029 - DNA, 18 bp, Arabidopsis thaliana
tcctcttcatcatcatca

SEQ ID NO: 6030 - DNA, 23 bp, Arabidopsis thaliana
cagcttgagcatgtggttgcatt

SEQ ID NO: 6031 - DNA, 21 bp, Arabidopsis thaliana
ttcaacagcttgagcatgtgg

SEQ ID NO: 6032 - DNA, 23 bp, Arabidopsis thaliana
tgctgttgctgttggtgctgctg

SEQ ID NO: 6033 - DNA, 22 bp, Arabidopsis thaliana
ttgctgcacttgttgctgctgc

SEQ ID NO: 6034 - DNA, 19 bp, Arabidopsis thaliana
tgtggcagtttcttcttgt

SEQ ID NO: 6035 - DNA, 21 bp, Arabidopsis thaliana
tgccaaaggagagttgccctg

SEQ ID NO: 6036 - DNA, 18 bp, Arabidopsis thaliana
ttaaggtgtttttgtgtg

SEQ ID NO: 6037 - DNA, 18 bp, Arabidopsis thaliana
tgcctgcgattacagtgt

SEQ ID NO: 6038 - DNA, 21 bp, Arabidopsis thaliana
atgttgattgatgttgctgat

SEQ ID NO: 6039 - DNA, 20 bp, Arabidopsis thaliana
agtgtggtgatgatgatgtt

SEQ ID NO: 6040 - DNA, 19 bp, Arabidopsis thaliana
agtctcaggttgttgacag

SEQ ID NO: 6041 - DNA, 21 bp, Arabidopsis thaliana
tgttgctgttgttgctggagg

SEQ ID NO: 6042 - DNA, 18 bp, Arabidopsis thaliana
ttgcttttgaagttgttg

SEQ ID NO: 6043 - DNA, 21 bp, Arabidopsis thaliana
agctgttgctgctggtgcggt

SEQ ID NO: 6044 - DNA, 18 bp, Arabidopsis thaliana
tcccgcgctgctgctgca

SEQ ID NO: 6045 - DNA, 20 bp, Arabidopsis thaliana
tgtttgtgtctgtctctctc

SEQ ID NO: 6046 - DNA, 21 bp, Arabidopsis thaliana
ctcccaggtgttgttgttgat

SEQ ID NO: 6047 - DNA, 19 bp, Arabidopsis thaliana
tggctcgaggtcatggaga

SEQ ID NO: 6048 - DNA, 21 bp, Arabidopsis thaliana
tcggaccaggcttcattcccc

SEQ ID NO: 6049 - DNA, 19 bp, Arabidopsis thaliana
tgagggcctgtgaaacagc

SEQ ID NO: 6050 - DNA, 18 bp, Arabidopsis thaliana
agagagagtgtctgtgac

SEQ ID NO: 6051 - DNA, 21 bp, Arabidopsis thaliana
tgcacctcctccagctccagc

SEQ ID NO: 6052 - DNA, 20 bp, Arabidopsis thaliana
ttgatgttgatgttcctgca

SEQ ID NO: 6053 - DNA, 19 bp, Arabidopsis thaliana
cagaagctggttgagagac

SEQ ID NO: 6054 - DNA, 18 bp, Arabidopsis thaliana
gatggtgatgatgctgat

SEQ ID NO: 6055 - DNA, 18 bp, Arabidopsis thaliana
aggtcatcttcatcgtag

SEQ ID NO: 6056 - DNA, 21 bp, Arabidopsis thaliana
atgatggtgttgagaatgaga

SEQ ID NO: 6057 - DNA, 23 bp, Arabidopsis thaliana
tgtaatgatgttgatgattgatg

SEQ ID NO: 6058 - DNA, 23 bp, Arabidopsis thaliana
tagctgattgttgttgatgcttt

SEQ ID NO: 6059 - DNA, 22 bp, Arabidopsis thaliana
ttcttcttcatcttcttgtcct

SEQ ID NO: 6060 - DNA, 19 bp, Arabidopsis thaliana
tgtggttcagtttctgcct

SEQ ID NO: 6061 - DNA, 23 bp, Arabidopsis thaliana
gaagatggagctggtggtgatga

SEQ ID NO: 6062 - DNA, 19 bp, Arabidopsis thaliana
tggtgccagttgcggtgga

SEQ ID NO: 6063 - DNA, 23 bp, Arabidopsis thaliana
ccacttgttcttcatcatcttct

SEQ ID NO: 6064 - DNA, 19 bp, Arabidopsis thaliana
attcgtttgatgttgcaga

SEQ ID NO: 6065 - DNA, 19 bp, Arabidopsis thaliana
agtggaggatagaagaagt

SEQ ID NO: 6066 - DNA, 20 bp, Arabidopsis thaliana
atgactgacaatcttgatct

SEQ ID NO: 6067 - DNA, 20 bp, Arabidopsis thaliana
atctgtttgttcatggtgat

SEQ ID NO: 6068 - DNA, 23 bp, Arabidopsis thaliana
gtggtatctttatgttgcagaac

SEQ ID NO: 6069 - DNA, 23 bp, Arabidopsis thaliana
tagagagagagagtgtgtgtgtg

SEQ ID NO: 6070 - DNA, 21 bp, Arabidopsis thaliana
tggagaagcagggcacgtgca

SEQ ID NO: 6071 - DNA, 21 bp, Arabidopsis thaliana
agtgtgatgatatggatgagt

SEQ ID NO: 6072 - DNA, 23 bp, Arabidopsis thaliana
gtactgctgctgctgctgctgag

SEQ ID NO: 6073 - DNA, 21 bp, Arabidopsis thaliana
atcatcgacgaacatcgagtt

SEQ ID NO: 6074 - DNA, 18 bp, Arabidopsis thaliana
acattggagattttgttg

SEQ ID NO: 6075 - DNA, 18 bp, Arabidopsis thaliana
ttgactgggagtttgatg

SEQ ID NO: 6076 - DNA, 20 bp, Arabidopsis thaliana
tattgtctgctaaggttcag

SEQ ID NO: 6077 - DNA, 21 bp, Arabidopsis thaliana
ttctgacagtcgatgtacttt

SEQ ID NO: 6078 - DNA, 20 bp, Arabidopsis thaliana
taagagaagcaatgttttag

SEQ ID NO: 6079 - DNA, 19 bp, Arabidopsis thaliana
gtgctcactctcttctgtc

SEQ ID NO: 6080 - DNA, 18 bp, Arabidopsis thaliana
gactcttcatggacttgt

SEQ ID NO: 6081 - DNA, 20 bp, Arabidopsis thaliana
tttgaactttgtggttgatg

SEQ ID NO: 6082 - DNA, 23 bp, Arabidopsis thaliana
agtgagcttctcagtctctctct

SEQ ID NO: 6083 - DNA, 18 bp, Arabidopsis thaliana
tatgtgcatcttttatga

SEQ ID NO: 6084 - DNA, 20 bp, Arabidopsis thaliana
aagtggagtgaagtgaaggg

SEQ ID NO: 6085 - DNA, 20 bp, Arabidopsis thaliana
tgtatgaatatcttgatgtt

SEQ ID NO: 6086 - DNA, 19 bp, Arabidopsis thaliana
tcagcttggacaagttgct

SEQ ID NO: 6087 - DNA, 18 bp, Arabidopsis thaliana
attcttcaagttcttgct

SEQ ID NO: 6088 - DNA, 19 bp, Arabidopsis thaliana
tgatgtgttgatggtctct

SEQ ID NO: 6089 - DNA, 23 bp, Arabidopsis thaliana
aaagtgcttcgattcatgggtct

SEQ ID NO: 6090 - DNA, 18 bp, Arabidopsis thaliana
accattgttgctgctatc

SEQ ID NO: 6091 - DNA, 21 bp, Arabidopsis thaliana
agactgttgatggtgctggag

SEQ ID NO: 6092 - DNA, 23 bp, Arabidopsis thaliana
tgacagaagagagtgagcacaca

SEQ ID NO: 6093 - DNA, 23 bp, Arabidopsis thaliana
tctctctctgtcaccccttctct

SEQ ID NO: 6094 - DNA, 19 bp, Arabidopsis thaliana
ttgagcttgatttagttgg

SEQ ID NO: 6095 - DNA, 19 bp, Arabidopsis thaliana
agctgtgagtccttcttgt

SEQ ID NO: 6096 - DNA, 18 bp, Arabidopsis thaliana
atgcagatgttgttgatg

SEQ ID NO: 6097 - DNA, 20 bp, Arabidopsis thaliana
tactctcttcttcttggaca

SEQ ID NO: 6098 - DNA, 23 bp, Arabidopsis thaliana
aactcctagctgtgtgtggattt

SEQ ID NO: 6099 - DNA, 22 bp, Arabidopsis thaliana
tgagtttggttttgtattcctg

SEQ ID NO: 6100 - DNA, 18 bp, Arabidopsis thaliana
agatgactgttcgactgt

SEQ ID NO: 6101 - DNA, 18 bp, Arabidopsis thaliana
tatatacacacacaccta

SEQ ID NO: 6102 - DNA, 23 bp, Arabidopsis thaliana
actgatgttgctgattgttgttt

SEQ ID NO: 6103 - DNA, 22 bp, Arabidopsis thaliana
tctcagtcacctaatgatgatg

SEQ ID NO: 6104 - DNA, 19 bp, Arabidopsis thaliana
ttggagggtatgtgtgtga

SEQ ID NO: 6105 - DNA, 20 bp, Arabidopsis thaliana
agcttgatgaagaagaagaa

SEQ ID NO: 6106 - DNA, 20 bp, Arabidopsis thaliana
tgtgttctcaggtcacccct

SEQ ID NO: 6107 - DNA, 20 bp, Arabidopsis thaliana
tgtgttctcaggtcacccct

SEQ ID NO: 6108 - DNA, 18 bp, Arabidopsis thaliana
tgtgcttctgctggggct

SEQ ID NO: 6109 - DNA, 18 bp, Arabidopsis thaliana
cagagaatgcatgttcat

SEQ ID NO: 6110 - DNA, 21 bp, Arabidopsis thaliana
agactgtctctgttcctgtct

SEQ ID NO: 6111 - DNA, 23 bp, Arabidopsis thaliana
atttgtttgatgatgatgatggt

SEQ ID NO: 6112 - DNA, 19 bp, Arabidopsis thaliana
tgagatgggtttggatgct

SEQ ID NO: 6113 - DNA, 18 bp, Arabidopsis thaliana
tgatgttctttttggttc

SEQ ID NO: 6114 - DNA, 21 bp, Arabidopsis thaliana
tcagcatgtagtttcttgttg

SEQ ID NO: 6115 - DNA, 19 bp, Arabidopsis thaliana
tatttgttcttcttcgaga

SEQ ID NO: 6116 - DNA, 20 bp, Arabidopsis thaliana
ttcaagaattttgttgatgg

SEQ ID NO: 6117 - DNA, 21 bp, Arabidopsis thaliana
ctgtgattggtttcttcggtg

SEQ ID NO: 6118 - DNA, 21 bp, Arabidopsis thaliana
atgaatttggatctaattgag

SEQ ID NO: 6119 - DNA, 21 bp, Arabidopsis thaliana
tttttcctcaaatttatccaa

SEQ ID NO: 6120 - DNA, 20 bp, Arabidopsis thaliana
cagtggatttgtgtgtatga

SEQ ID NO: 6121 - DNA, 20 bp, Arabidopsis thaliana
ctattgttatgatgatgatg

SEQ ID NO: 6122 - DNA, 22 bp, Arabidopsis thaliana
tcttgtctgttcttgttgtagt

SEQ ID NO: 6123 - DNA, 20 bp, Arabidopsis thaliana
ttgggactggaactggtctg

SEQ ID NO: 6124 - DNA, 23 bp, Arabidopsis thaliana
ttcttgttcttcttcaactactt

SEQ ID NO: 6125 - DNA, 23 bp, Arabidopsis thaliana
agtccaagtatgttgttgttatt

SEQ ID NO: 6126 - DNA, 21 bp, Arabidopsis thaliana
acacagccattgttcttcatc

SEQ ID NO: 6127 - DNA, 23 bp, Arabidopsis thaliana
acattcttgttgttgttgcagtg

SEQ ID NO: 6128 - DNA, 19 bp, Arabidopsis thaliana
agactgtccaatccctagt

SEQ ID NO: 6129 - DNA, 20 bp, Arabidopsis thaliana
atgaaaactgtttttggggt

SEQ ID NO: 6130 - DNA, 18 bp, Arabidopsis thaliana
tgtgtgtctttgactctg

SEQ ID NO: 6131 - DNA, 19 bp, Arabidopsis thaliana
gtcataagatttgattggt

SEQ ID NO: 6132 - DNA, 19 bp, Arabidopsis thaliana
tctgctgttgttgctgatg

SEQ ID NO: 6133 - DNA, 20 bp, Arabidopsis thaliana
tgtcactctctctttctctc

SEQ ID NO: 6134 - DNA, 23 bp, Arabidopsis thaliana
aagttagagtgcatgtgcttctc

SEQ ID NO: 6135 - DNA, 18 bp, Arabidopsis thaliana
atctgtttgttcttggta

SEQ ID NO: 6136 - DNA, 22 bp, Arabidopsis thaliana
tatgagagtgttgttgttcttg

SEQ ID NO: 6137 - DNA, 19 bp, Arabidopsis thaliana
tttgttgtttttagttgta

SEQ ID NO: 6138 - DNA, 21 bp, Arabidopsis thaliana
agtgaagatcctagtgtgagg

SEQ ID NO: 6139 - DNA, 23 bp, Arabidopsis thaliana
tttgatcttcttcttcatcctca

SEQ ID NO: 6140 - DNA, 18 bp, Arabidopsis thaliana
agagcttggatttagatt

SEQ ID NO: 6141 - DNA, 21 bp, Arabidopsis thaliana
tcatgatgatgatgatgatga

SEQ ID NO: 6142 - DNA, 22 bp, Arabidopsis thaliana
ttgctcttctttgacttgctgt

SEQ ID NO: 6143 - DNA, 20 bp, Arabidopsis thaliana
tatgtgtgaggaattgttgg

SEQ ID NO: 6144 - DNA, 23 bp, Arabidopsis thaliana
tagttagtgtgcgtctgattctg

SEQ ID NO: 6145 - DNA, 20 bp, Arabidopsis thaliana
tcttcttcctcatgctgctc

SEQ ID NO: 6146 - DNA, 20 bp, Arabidopsis thaliana
atgatgatgatcttcatctt

SEQ ID NO: 6147 - DNA, 23 bp, Arabidopsis thaliana
tgagcctggtgatgtgtgtgtga

SEQ ID NO: 6148 - DNA, 23 bp, Arabidopsis thaliana
gagtcttcttcttcttcaaccac

SEQ ID NO: 6149 - DNA, 18 bp, Arabidopsis thaliana
aatggtgttgatgctggt

SEQ ID NO: 6150 - DNA, 22 bp, Arabidopsis thaliana
actgacacttttgagtgttgtg

SEQ ID NO: 6151 - DNA, 20 bp, Arabidopsis thaliana
tgatgatcatcttcttcctg

SEQ ID NO: 6152 - DNA, 18 bp, Arabidopsis thaliana
atgaagaagatgaaggtg

SEQ ID NO: 6153 - DNA, 18 bp, Arabidopsis thaliana
tcactctgtgtgggagcc

SEQ ID NO: 6154 - DNA, 19 bp, Arabidopsis thaliana
catactcatcttcctcctc

SEQ ID NO: 6155 - DNA, 19 bp, Arabidopsis thaliana
tggttatccggctgttgtg

SEQ ID NO: 6156 - DNA, 20 bp, Arabidopsis thaliana
tggctttgcaattgatggtg

SEQ ID NO: 6157 - DNA, 21 bp, Arabidopsis thaliana
ttgttgttgttgctgctggag

SEQ ID NO: 6158 - DNA, 23 bp, Arabidopsis thaliana
ttgagactgcaattgttgttgct

SEQ ID NO: 6159 - DNA, 20 bp, Arabidopsis thaliana
tctcctcctcctcctccgac

SEQ ID NO: 6160 - DNA, 18 bp, Arabidopsis thaliana
atcgtcttgttgttggac

SEQ ID NO: 6161 - DNA, 18 bp, Arabidopsis thaliana
gatgaatgatgatgcttt

SEQ ID NO: 6162 - DNA, 19 bp, Arabidopsis thaliana
gagaagagagagagaggag

SEQ ID NO: 6163 - DNA, 18 bp, Arabidopsis thaliana
aagagattccatcttcta

SEQ ID NO: 6164 - DNA, 20 bp, Arabidopsis thaliana
gtccaccaccgtgatggagg

SEQ ID NO: 6165 - DNA, 23 bp, Arabidopsis thaliana
tgagcaagagacagctagtgtgt

SEQ ID NO: 6166 - DNA, 19 bp, Arabidopsis thaliana
agatcagagattatgatga

SEQ ID NO: 6167 - DNA, 18 bp, Arabidopsis thaliana
aatgatgatgatgatgat

SEQ ID NO: 6168 - DNA, 18 bp, Arabidopsis thaliana
cttcttgttcgtggtgga

SEQ ID NO: 6169 - DNA, 20 bp, Arabidopsis thaliana
aagcacatctgcgggggaac

SEQ ID NO: 6170 - DNA, 20 bp, Arabidopsis thaliana
tatgtgtctctgattcacga

SEQ ID NO: 6171 - DNA, 21 bp, Arabidopsis thaliana
ttttgagtgatatccttgggt

SEQ ID NO: 6172 - DNA, 19 bp, Arabidopsis thaliana
aacaggttaacttcttctt

SEQ ID NO: 6173 - DNA, 18 bp, Arabidopsis thaliana
tggattactgtttgattg

SEQ ID NO: 6174 - DNA, 19 bp, Arabidopsis thaliana
tctaatgttgttgctttgc

SEQ ID NO: 6175 - DNA, 22 bp, Arabidopsis thaliana
atagctcattaattggatcttg

SEQ ID NO: 6176 - DNA, 19 bp, Arabidopsis thaliana
ttgctcttcttcatcatgt

SEQ ID NO: 6177 - DNA, 23 bp, Arabidopsis thaliana
gtttcagctttgtgtgcttgctc

SEQ ID NO: 6178 - DNA, 20 bp, Arabidopsis thaliana
gatgattcatgaggatgatg

SEQ ID NO: 6179 - DNA, 22 bp, Arabidopsis thaliana
gtgttggatagttgaaagttca

SEQ ID NO: 6180 - DNA, 21 bp, Arabidopsis thaliana
cagccaaggatgacttgccgg

SEQ ID NO: 6181 - DNA, 20 bp, Arabidopsis thaliana
agaggatgttgttgtgagtg

SEQ ID NO: 6182 - DNA, 18 bp, Arabidopsis thaliana
ttctttgcattttcttga

SEQ ID NO: 6183 - DNA, 20 bp, Arabidopsis thaliana
atctggtgcaaagtggcagt

SEQ ID NO: 6184 - DNA, 21 bp, Arabidopsis thaliana
tttgttagctattgttgttct

SEQ ID NO: 6185 - DNA, 20 bp, Arabidopsis thaliana
agtgtgtgtggttgaggtca

SEQ ID NO: 6186 - DNA, 23 bp, Arabidopsis thaliana
gatcatcatcatcatcatcatca

SEQ ID NO: 6187 - DNA, 22 bp, Arabidopsis thaliana
atggtgatgatgatgatgatga

SEQ ID NO: 6188 - DNA, 22 bp, Arabidopsis thaliana
ttctatgtgcatgtgcatgaga

SEQ ID NO: 6189 - DNA, 21 bp, Arabidopsis thaliana
tcaatagattggactatgtat

SEQ ID NO: 6190 - DNA, 21 bp, Arabidopsis thaliana
tcaatgtgttgtattgttgat

SEQ ID NO: 6191 - DNA, 23 bp, Arabidopsis thaliana
tgacagaagagagtgagcacaca

SEQ ID NO: 6192 - DNA, 21 bp, Arabidopsis thaliana
atttgtgtctgcttcttctct

SEQ ID NO: 6193 - DNA, 19 bp, Arabidopsis thaliana
catcatcctcttgttcttc

SEQ ID NO: 6194 - DNA, 23 bp, Arabidopsis thaliana
tgaggttctttgttattgtgttg

SEQ ID NO: 6195 - DNA, 20 bp, Arabidopsis thaliana
aaagtgattccactaagtct

SEQ ID NO: 6196 - DNA, 18 bp, Arabidopsis thaliana
tgtagctcgtagagtgtg

SEQ ID NO: 6197 - DNA, 21 bp, Arabidopsis thaliana
ttagtgtcagtatatgtgtgt

SEQ ID NO: 6198 - DNA, 21 bp, Arabidopsis thaliana
agttggtgctgctgctgtggt

SEQ ID NO: 6199 - DNA, 19 bp, Arabidopsis thaliana
tctcctccaactccaaggt

SEQ ID NO: 6200 - DNA, 19 bp, Arabidopsis thaliana
tcaagaatgatggaggtct

SEQ ID NO: 6201 - DNA, 23 bp, Arabidopsis thaliana
ttgctgagctgctgcagctgctg

SEQ ID NO: 6202 - DNA, 19 bp, Arabidopsis thaliana
ttcattgtcttcttcttca

SEQ ID NO: 6203 - DNA, 21 bp, Arabidopsis thaliana
gatttgtacgtacactgttca

SEQ ID NO: 6204 - DNA, 23 bp, Arabidopsis thaliana
tgagtttcttgatgttgctggag

SEQ ID NO: 6205 - DNA, 19 bp, Arabidopsis thaliana
tgaagagaattgaagatga

SEQ ID NO: 6206 - DNA, 19 bp, Arabidopsis thaliana
tatgtgagatttaattgac

SEQ ID NO: 6207 - DNA, 21 bp, Arabidopsis thaliana
ttggactgaagggagctccct

SEQ ID NO: 6208 - DNA, 23 bp, Arabidopsis thaliana
tatcattcttgatgatgtagatg

SEQ ID NO: 6209 - DNA, 21 bp, Arabidopsis thaliana
tatcaatggttcgtgtgagag

SEQ ID NO: 6210 - DNA, 23 bp, Arabidopsis thaliana
tcatcatcatcatcatcatctgc

SEQ ID NO: 6211 - DNA, 20 bp, Arabidopsis thaliana
ttaggttatgttgcttgtag

SEQ ID NO: 6212 - DNA, 19 bp, Arabidopsis thaliana
tctgttcttgatgctgctg

SEQ ID NO: 6213 - DNA, 23 bp, Arabidopsis thaliana
ttgtgtgtatgtatgtatatttg

SEQ ID NO: 6214 - DNA, 23 bp, Arabidopsis thaliana
atcttcgtcatcatcatcattat

SEQ ID NO: 6215 - DNA, 18 bp, Arabidopsis thaliana
gatgaagaagcagaggag

SEQ ID NO: 6216 - DNA, 20 bp, Arabidopsis thaliana
atatgaatcttgatgttgat

SEQ ID NO: 6217 - DNA, 23 bp, Arabidopsis thaliana
tcatcatcttcttcttcatcgtc

SEQ ID NO: 6218 - DNA, 20 bp, Arabidopsis thaliana
atagtgaaaggtaaagccgt

SEQ ID NO: 6219 - DNA, 21 bp, Arabidopsis thaliana
tcaaggaacggattttgttaa

SEQ ID NO: 6220 - DNA, 20 bp, Arabidopsis thaliana
acaaaatccgtctttgaaga

SEQ ID NO: 6221 - DNA, 23 bp, Arabidopsis thaliana
aagattgttgatgatgttgctga

SEQ ID NO: 6222 - DNA, 23 bp, Arabidopsis thaliana
aaagtctgatgttgttgttgatg

SEQ ID NO: 6223 - DNA, 23 bp, Arabidopsis thaliana
agcattgttgctggatttgtgtg

SEQ ID NO: 6224 - DNA, 19 bp, Arabidopsis thaliana
ccacgttgtggccgtggag

SEQ ID NO: 6225 - DNA, 19 bp, Arabidopsis thaliana
agtgattagtgaatgttca

SEQ ID NO: 6226 - DNA, 23 bp, Arabidopsis thaliana
cttgtgagtgtttgttcttggtt

SEQ ID NO: 6227 - DNA, 21 bp, Arabidopsis thaliana
gtatgaatgcatggatgcatg

SEQ ID NO: 6228 - DNA, 20 bp, Arabidopsis thaliana
tcatgatgtaaattcttcat

SEQ ID NO: 6229 - DNA, 21 bp, Arabidopsis thaliana
aggtgctggtgcagatgcggt

SEQ ID NO: 6230 - DNA, 19 bp, Arabidopsis thaliana
tgtgctcttactatataga

SEQ ID NO: 6231 - DNA, 18 bp, Arabidopsis thaliana
accatcaaattaaatgag

SEQ ID NO: 6232 - DNA, 20 bp, Arabidopsis thaliana
tctctgattctgtgatcttg

SEQ ID NO: 6233 - DNA, 20 bp, Arabidopsis thaliana
attgcagtttgtgcatcatt

SEQ ID NO: 6234 - DNA, 23 bp, Arabidopsis thaliana
aacggtttctgatgttggtgcag

SEQ ID NO: 6235 - DNA, 19 bp, Arabidopsis thaliana
agatgaatgtggatggtga

SEQ ID NO: 6236 - DNA, 19 bp, Arabidopsis thaliana
tgttgttgcagttagtgct

SEQ ID NO: 6237 - DNA, 20 bp, Arabidopsis thaliana
atcagctttgtttttgttga

SEQ ID NO: 6238 - DNA, 23 bp, Arabidopsis thaliana
taagactgtctgcttaggttcaa

SEQ ID NO: 6239 - DNA, 18 bp, Arabidopsis thaliana
tgtgcatcatgatagcat

SEQ ID NO: 6240 - DNA, 19 bp, Arabidopsis thaliana
aggaatgttgtttgtttac

SEQ ID NO: 6241 - DNA, 20 bp, Arabidopsis thaliana
tgagattgttgttgatagag

SEQ ID NO: 6242 - DNA, 23 bp, Arabidopsis thaliana
agttgttggtgatggttctcatg

SEQ ID NO: 6243 - DNA, 23 bp, Arabidopsis thaliana
gatagagctgttggtgatggttc

SEQ ID NO: 6244 - DNA, 23 bp, Arabidopsis thaliana
tgttggtgatgatgttgatggat

SEQ ID NO: 6245 - DNA, 23 bp, Arabidopsis thaliana
tctgtatccaaatgttcttgttc

SEQ ID NO: 6246 - DNA, 23 bp, Arabidopsis thaliana
atgtgaatgcttttgaaaacgcg

SEQ ID NO: 6247 - DNA, 18 bp, Arabidopsis thaliana
acagaagatggtgacctc

SEQ ID NO: 6248 - DNA, 22 bp, Arabidopsis thaliana
ttagtgcatggatttggtttgt

SEQ ID NO: 6249 - DNA, 20 bp, Arabidopsis thaliana
gaaacaggtgtcgatcgaca

SEQ ID NO: 6250 - DNA, 20 bp, Arabidopsis thaliana
tgcttgttgttgttgtggag

SEQ ID NO: 6251 - DNA, 20 bp, Arabidopsis thaliana
gtgcatggaagatgcattgg

SEQ ID NO: 6252 - DNA, 19 bp, Arabidopsis thaliana
agttctaattcttcctgaa

SEQ ID NO: 6253 - DNA, 21 bp, Arabidopsis thaliana
agtctgttcttgtatgtgtct

SEQ ID NO: 6254 - DNA, 19 bp, Arabidopsis thaliana
tttttcttcttcttgctct

SEQ ID NO: 6255 - DNA, 21 bp, Arabidopsis thaliana
agttttctgtagatgagctca

SEQ ID NO: 6256 - DNA, 20 bp, Arabidopsis thaliana
agaatggtctgtgctgcttc

SEQ ID NO: 6257 - DNA, 19 bp, Arabidopsis thaliana
agaggatggaagttggcgt

SEQ ID NO: 6258 - DNA, 21 bp, Arabidopsis thaliana
acttggagctgttgacgagct

SEQ ID NO: 6259 - DNA, 21 bp, Arabidopsis thaliana
taagtgtgtgctttagttgtg

SEQ ID NO: 6260 - DNA, 18 bp, Arabidopsis thaliana
aactggtgtcgatcgaca

SEQ ID NO: 6261 - DNA, 19 bp, Arabidopsis thaliana
tctttggaattgttgcttt

SEQ ID NO: 6262 - DNA, 18 bp, Arabidopsis thaliana
tatgttgcattagctcat

SEQ ID NO: 6263 - DNA, 18 bp, Arabidopsis thaliana
tgtgtcgatcgacactct

SEQ ID NO: 6264 - DNA, 21 bp, Arabidopsis thaliana
agagaattgttgttgttcttg

SEQ ID NO: 6265 - DNA, 19 bp, Arabidopsis thaliana
gatttgtgcttgtttgctt

SEQ ID NO: 6266 - DNA, 19 bp, Arabidopsis thaliana
tgtctctgaagcaaccaga

SEQ ID NO: 6267 - DNA, 18 bp, Arabidopsis thaliana
ttctacgagacgaactgg

SEQ ID NO: 6268 - DNA, 21 bp, Arabidopsis thaliana
cgaaactggtgtcgatcgaca

SEQ ID NO: 6269 - DNA, 18 bp, Arabidopsis thaliana
acacaacttgatcatctc

SEQ ID NO: 6270 - DNA, 23 bp, Arabidopsis thaliana
tcttcgtcatcttcctcttcgtc

SEQ ID NO: 6271 - DNA, 19 bp, Arabidopsis thaliana
tgtttttatgatgtagttg

SEQ ID NO: 6272 - DNA, 21 bp, Arabidopsis thaliana
tctctgcatgtgaagctgcat

SEQ ID NO: 6273 - DNA, 19 bp, Arabidopsis thaliana
aaactggtgtcgatcgaca

SEQ ID NO: 6274 - DNA, 22 bp, Arabidopsis thaliana
ttgtgctttcatgatcatgagt

SEQ ID NO: 6275 - DNA, 19 bp, Arabidopsis thaliana
gcttgttgttgatgtggtg

SEQ ID NO: 6276 - DNA, 23 bp, Arabidopsis thaliana
gactctcctgatgatgatgtaca

SEQ ID NO: 6277 - DNA, 19 bp, Arabidopsis thaliana
tgtgtttgatcttggtggt

SEQ ID NO: 6278 - DNA, 19 bp, Arabidopsis thaliana
ccgtggtgatgattttggt

SEQ ID NO: 6279 - DNA, 22 bp, Arabidopsis thaliana
tgtagtgatttgatgatgatga

SEQ ID NO: 6280 - DNA, 21 bp, Arabidopsis thaliana
taatgcatcatctaactggaa

SEQ ID NO: 6281 - DNA, 21 bp, Arabidopsis thaliana
ggttcgtacgtacgctgttca

SEQ ID NO: 6282 - DNA, 21 bp, Arabidopsis thaliana
tgatgaaaaatcatgaacttt

SEQ ID NO: 6283 - DNA, 19 bp, Arabidopsis thaliana
aagaagtctgttgcagctc

SEQ ID NO: 6284 - DNA, 23 bp, Arabidopsis thaliana
agttgttggtgatggttctcatg

SEQ ID NO: 6285 - DNA, 23 bp, Arabidopsis thaliana
gatagagctgttggtgatggttc

SEQ ID NO: 6286 - DNA, 21 bp, Arabidopsis thaliana
ctcacactctctttttctcac

SEQ ID NO: 6287 - DNA, 23 bp, Arabidopsis thaliana
tgcacatactgctttgtctgctc

SEQ ID NO: 6288 - DNA, 23 bp, Arabidopsis thaliana
cattgttgttgatgttgatgatc

SEQ ID NO: 6289 - DNA, 21 bp, Arabidopsis thaliana
tccacctggtcctgctgctgc

SEQ ID NO: 6290 - DNA, 18 bp, Arabidopsis thaliana
atgctgcgtcttgttgtt

SEQ ID NO: 6291 - DNA, 22 bp, Arabidopsis thaliana
taggtagtttgatcttgatcgt

SEQ ID NO: 6292 - DNA, 21 bp, Arabidopsis thaliana
atctttgagttgttgttcaat

SEQ ID NO: 6293 - DNA, 18 bp, Arabidopsis thaliana
ttagtgatgttgatgact

SEQ ID NO: 6294 - DNA, 19 bp, Arabidopsis thaliana
gtgctcactctcttctgtc

SEQ ID NO: 6295 - DNA, 19 bp, Arabidopsis thaliana
agtggtagtttggaggagt

SEQ ID NO: 6296 - DNA, 21 bp, Arabidopsis thaliana
tcaatagattggactatatat

SEQ ID NO: 6297 - DNA, 18 bp, Arabidopsis thaliana
tgagtctccatggctatg

SEQ ID NO: 6298 - DNA, 20 bp, Arabidopsis thaliana
ggacctggtggtgttgctgg

SEQ ID NO: 6299 - DNA, 22 bp, Arabidopsis thaliana
atgtatgtgttcatgtgtgcat

SEQ ID NO: 6300 - DNA, 22 bp, Arabidopsis thaliana
ttgtatgtgttcatgtgtgcat

SEQ ID NO: 6301 - DNA, 21 bp, Arabidopsis thaliana
tggatcttggtgatgcaggtg

SEQ ID NO: 6302 - DNA, 23 bp, Arabidopsis thaliana
atcgtgtgtgtgtgtgtgtagct

SEQ ID NO: 6303 - DNA, 18 bp, Arabidopsis thaliana
gatgagttttgatgttcg

SEQ ID NO: 6304 - DNA, 19 bp, Arabidopsis thaliana
atttgtgtgtgattgatga

SEQ ID NO: 6305 - DNA, 23 bp, Arabidopsis thaliana
aggttgttgttggtgcaggagaa

SEQ ID NO: 6306 - DNA, 18 bp, Arabidopsis thaliana
tgtgtgtgtgtgtgtgtg

SEQ ID NO: 6307 - DNA, 19 bp, Arabidopsis thaliana
ggtgatgatgatcgtcgtc

SEQ ID NO: 6308 - DNA, 23 bp, Arabidopsis thaliana
tcatcatcatcatcttcatcgac

SEQ ID NO: 6309 - DNA, 23 bp, Arabidopsis thaliana
aaattagagattttgttgttggt

SEQ ID NO: 6310 - DNA, 19 bp, Arabidopsis thaliana
tttgaattactttgttgtt

SEQ ID NO: 6311 - DNA, 20 bp, Arabidopsis thaliana
tcgtcttcttcgtcatctga

SEQ ID NO: 6312 - DNA, 22 bp, Arabidopsis thaliana
tctgagtttggtgaggttgaag

SEQ ID NO: 6313 - DNA, 19 bp, Arabidopsis thaliana
taaagtagttcagctgctg

SEQ ID NO: 6314 - DNA, 23 bp, Arabidopsis thaliana
atctgatgatgttgatgatgctg

SEQ ID NO: 6315 - DNA, 20 bp, Arabidopsis thaliana
atgatgatgatggttgttca

SEQ ID NO: 6316 - DNA, 21 bp, Arabidopsis thaliana
tcgataaacctctgcatccag

SEQ ID NO: 6317 - DNA, 22 bp, Arabidopsis thaliana
tgtgtgtgtgtgtggtacctct

SEQ ID NO: 6318 - DNA, 21 bp, Arabidopsis thaliana
ttttgtctgttgatggtgaaa

SEQ ID NO: 6319 - DNA, 23 bp, Arabidopsis thaliana
aaagtgctgtgtgtgatgatgtt

SEQ ID NO: 6320 - DNA, 23 bp, Arabidopsis thaliana
tcttcctcttctagatcttcctc

SEQ ID NO: 6321 - DNA, 18 bp, Arabidopsis thaliana
agtatgatgatgatggtg

SEQ ID NO: 6322 - DNA, 23 bp, Arabidopsis thaliana
tgtatgtgtgtgtgtttgtctat

SEQ ID NO: 6323 - DNA, 22 bp, Arabidopsis thaliana
tatgtgaatgatgatgatgtgt

SEQ ID NO: 6324 - DNA, 18 bp, Arabidopsis thaliana
aaccagtgttgtacttga

SEQ ID NO: 6325 - DNA, 18 bp, Arabidopsis thaliana
gcgcctccttattgagcg

SEQ ID NO: 6326 - DNA, 20 bp, Arabidopsis thaliana
tgtgcatcatgtttcagctg

SEQ ID NO: 6327 - DNA, 20 bp, Arabidopsis thaliana
tgtgcatcatgtttcagctg

SEQ ID NO: 6328 - DNA, 23 bp, Arabidopsis thaliana
ttgaattgtgatgatgatgattg

SEQ ID NO: 6329 - DNA, 18 bp, Arabidopsis thaliana
tgaggtatatagttggat

SEQ ID NO: 6330 - DNA, 19 bp, Arabidopsis thaliana
agagctcatgctgcagctg

SEQ ID NO: 6331 - DNA, 18 bp, Arabidopsis thaliana
ttcatagtcttgcagttg

SEQ ID NO: 6332 - DNA, 23 bp, Arabidopsis thaliana
agcctgttgatgggcttgtgtct

SEQ ID NO: 6333 - DNA, 21 bp, Arabidopsis thaliana
tgttggcttttgatgatgatg

SEQ ID NO: 6334 - DNA, 20 bp, Arabidopsis thaliana
ttgcttcattatgaagccat

SEQ ID NO: 6335 - DNA, 19 bp, Arabidopsis thaliana
tgtggttggttttgatgat

SEQ ID NO: 6336 - DNA, 20 bp, Arabidopsis thaliana
tgatgatcatcttcttcctg

SEQ ID NO: 6337 - DNA, 21 bp, Arabidopsis thaliana
tttgtgagttgtgagagtagt

SEQ ID NO: 6338 - DNA, 18 bp, Arabidopsis thaliana
aatctgttgatcaagctg

SEQ ID NO: 6339 - DNA, 19 bp, Arabidopsis thaliana
agagaaaagttttagatgt

SEQ ID NO: 6340 - DNA, 23 bp, Arabidopsis thaliana
ttctacaagaagatgatgatcat

SEQ ID NO: 6341 - DNA, 22 bp, Arabidopsis thaliana
tatccatcatcatcatcatcat

SEQ ID NO: 6342 - DNA, 20 bp, Arabidopsis thaliana
tatcagtgtcttgttattca

SEQ ID NO: 6343 - DNA, 21 bp, Arabidopsis thaliana
taagtgtgtgtgtgtgagtta

SEQ ID NO: 6344 - DNA, 20 bp, Arabidopsis thaliana
tggttgttatatgttgtagg

SEQ ID NO: 6345 - DNA, 19 bp, Arabidopsis thaliana
aacaacttccttgtttctg

SEQ ID NO: 6346 - DNA, 22 bp, Arabidopsis thaliana
atgttgaagttgtttgttgtga

SEQ ID NO: 6347 - DNA, 20 bp, Arabidopsis thaliana
actcgattctttctcagatg

SEQ ID NO: 6348 - DNA, 20 bp, Arabidopsis thaliana
acacagtctctttctctctc

SEQ ID NO: 6349 - DNA, 19 bp, Arabidopsis thaliana
ttgtgagtttgtatgtaga

SEQ ID NO: 6350 - DNA, 23 bp, Arabidopsis thaliana
tgtttgagtggatgcatgttgat

SEQ ID NO: 6351 - DNA, 19 bp, Arabidopsis thaliana
gagctcagcaagatttgtg

SEQ ID NO: 6352 - DNA, 21 bp, Arabidopsis thaliana
tgagctatcataatttggctg

SEQ ID NO: 6353 - DNA, 23 bp, Arabidopsis thaliana
ttcatcatgatgatgatgatgat

SEQ ID NO: 6354 - DNA, 22 bp, Arabidopsis thaliana
tgcaatcaaaacgaggaagcat

SEQ ID NO: 6355 - DNA, 18 bp, Arabidopsis thaliana
gattcagaagttgcacat

SEQ ID NO: 6356 - DNA, 22 bp, Arabidopsis thaliana
tatgatcctcttacttttgctg

SEQ ID NO: 6357 - DNA, 23 bp, Arabidopsis thaliana
aagtgtgtccatttgtatgtgtg

SEQ ID NO: 6358 - DNA, 23 bp, Arabidopsis thaliana
gcattgctagttgttgttgtgga

SEQ ID NO: 6359 - DNA, 23 bp, Arabidopsis thaliana
gaactgagactttggtgtttgtt

SEQ ID NO: 6360 - DNA, 23 bp, Arabidopsis thaliana
cagtaactttgattcatccacgt

SEQ ID NO: 6361 - DNA, 19 bp, Arabidopsis thaliana
atgctgatcatgatgatga

SEQ ID NO: 6362 - DNA, 18 bp, Arabidopsis thaliana
cacactctctgtctctct

SEQ ID NO: 6363 - DNA, 23 bp, Arabidopsis thaliana
ttatcttcttcatcatctactcc

SEQ ID NO: 6364 - DNA, 21 bp, Arabidopsis thaliana
agagagtgagagagcgagaga

SEQ ID NO: 6365 - DNA, 22 bp, Arabidopsis thaliana
tgacatgggactgcctaagcta

SEQ ID NO: 6366 - DNA, 23 bp, Arabidopsis thaliana
tatctgtgtgtgtgaaggagaga

SEQ ID NO: 6367 - DNA, 19 bp, Arabidopsis thaliana
tctctgtgtagccttctct

SEQ ID NO: 6368 - DNA, 20 bp, Arabidopsis thaliana
tctatggttttgtatccttg

SEQ ID NO: 6369 - DNA, 23 bp, Arabidopsis thaliana
tgaaactccatgtgcatgtgtgt

SEQ ID NO: 6370 - DNA, 23 bp, Arabidopsis thaliana
agatcttcttcttcttggtgatg

SEQ ID NO: 6371 - DNA, 22 bp, Arabidopsis thaliana
gctctcgtgtgtgtgtgtctct

SEQ ID NO: 6372 - DNA, 18 bp, Arabidopsis thaliana
tatgtcgtaaaatttgga

SEQ ID NO: 6373 - DNA, 20 bp, Arabidopsis thaliana
agctgctgctgctgctggtg

SEQ ID NO: 6374 - DNA, 18 bp, Arabidopsis thaliana
tgagagcttccactcggt

SEQ ID NO: 6375 - DNA, 20 bp, Arabidopsis thaliana
tctgtttgttgaaggtgtct

SEQ ID NO: 6376 - DNA, 19 bp, Arabidopsis thaliana
caacatcatcatcatcatc

SEQ ID NO: 6377 - DNA, 18 bp, Arabidopsis thaliana
tagagtcatgttgttgag

SEQ ID NO: 6378 - DNA, 21 bp, Arabidopsis thaliana
ttgacagggcttatgttcttg

SEQ ID NO: 6379 - DNA, 23 bp, Arabidopsis thaliana
tggtcatgatcatcttcttcttg

SEQ ID NO: 6380 - DNA, 22 bp, Arabidopsis thaliana
ttgacagaagagagtgagcaca

SEQ ID NO: 6381 - DNA, 18 bp, Arabidopsis thaliana
tgagtgtgtgtttctaaa

SEQ ID NO: 6382 - DNA, 18 bp, Arabidopsis thaliana
tgtgatctctctcttgct

SEQ ID NO: 6383 - DNA, 23 bp, Arabidopsis thaliana
tctttggttttctacatgatgaa

SEQ ID NO: 6384 - DNA, 18 bp, Arabidopsis thaliana
agtttgtatgggaatgtt

SEQ ID NO: 6385 - DNA, 19 bp, Arabidopsis thaliana
tagtactagagcagcagca

SEQ ID NO: 6386 - DNA, 23 bp, Arabidopsis thaliana
tgtgttgttggtgctggactgct

SEQ ID NO: 6387 - DNA, 18 bp, Arabidopsis thaliana
tagtggttcgtgttttga

SEQ ID NO: 6388 - DNA, 21 bp, Arabidopsis thaliana
tcgataaacctctgcatccag

SEQ ID NO: 6389 - DNA, 23 bp, Arabidopsis thaliana
atcatgatgatgatgatgatgat

SEQ ID NO: 6390 - DNA, 20 bp, Arabidopsis thaliana
tgtgttgcagagttgcaggt

SEQ ID NO: 6391 - DNA, 18 bp, Arabidopsis thaliana
atgctggtcatcatcaat

SEQ ID NO: 6392 - DNA, 21 bp, Arabidopsis thaliana
tataggggtgatagtggtgct

SEQ ID NO: 6393 - DNA, 21 bp, Arabidopsis thaliana
aagtttttgaagatgatgaat

SEQ ID NO: 6394 - DNA, 20 bp, Arabidopsis thaliana
tgaggttggtgtgagagatg

SEQ ID NO: 6395 - DNA, 23 bp, Arabidopsis thaliana
tttgctgtgactctctctctctc

SEQ ID NO: 6396 - DNA, 20 bp, Arabidopsis thaliana
tttttctgctttcactgatg

SEQ ID NO: 6397 - DNA, 21 bp, Arabidopsis thaliana
cagatcgttgtcatcctcttc

SEQ ID NO: 6398 - DNA, 21 bp, Arabidopsis thaliana
tatgtcatttgttgttgggtt

SEQ ID NO: 6399 - DNA, 23 bp, Arabidopsis thaliana
catcatcatgatgatgatcatca

SEQ ID NO: 6400 - DNA, 21 bp, Arabidopsis thaliana
atgtgtgtgttgatgtcgttt

SEQ ID NO: 6401 - DNA, 21 bp, Arabidopsis thaliana
attgtatggttttggagtagt

SEQ ID NO: 6402 - DNA, 19 bp, Arabidopsis thaliana
tctgtgtgaattttgatgt

SEQ ID NO: 6403 - DNA, 19 bp, Arabidopsis thaliana
ttcttcatgttcttcttca

SEQ ID NO: 6404 - DNA, 23 bp, Arabidopsis thaliana
tgtcagcgagagagagagagaca

SEQ ID NO: 6405 - DNA, 23 bp, Arabidopsis thaliana
tgagaatcttgatgatgctgcat

SEQ ID NO: 6406 - DNA, 18 bp, Arabidopsis thaliana
taagaaagattgatcctt

SEQ ID NO: 6407 - DNA, 20 bp, Arabidopsis thaliana
attggcattggtagaaatga

SEQ ID NO: 6408 - DNA, 22 bp, Arabidopsis thaliana
tgtcaaagttcatgaacttgta

SEQ ID NO: 6409 - DNA, 23 bp, Arabidopsis thaliana
tcatgctgcttcttcttctcaag

SEQ ID NO: 6410 - DNA, 18 bp, Arabidopsis thaliana
atttctatgttgctgctg

SEQ ID NO: 6411 - DNA, 21 bp, Arabidopsis thaliana
tgcgggaagcatttgcacatg

SEQ ID NO: 6412 - DNA, 23 bp, Arabidopsis thaliana
aatcctcatcatcatcatcatca

SEQ ID NO: 6413 - DNA, 23 bp, Arabidopsis thaliana
taatgatgatgatgatgatgatg

SEQ ID NO: 6414 - DNA, 23 bp, Arabidopsis thaliana
gggtgagagagagacagagagac

SEQ ID NO: 6415 - DNA, 22 bp, Arabidopsis thaliana
gctgagaatgctgctgatgttg

SEQ ID NO: 6416 - DNA, 20 bp, Arabidopsis thaliana
agtgagtgagagagaaagac

SEQ ID NO: 6417 - DNA, 20 bp, Arabidopsis thaliana
ttgtcttcgtcatcttcttc

SEQ ID NO: 6418 - DNA, 19 bp, Arabidopsis thaliana
gactgtctctatctctgtc

SEQ ID NO: 6419 - DNA, 23 bp, Arabidopsis thaliana
tcagactgctgttgttggtggtg

SEQ ID NO: 6420 - DNA, 21 bp, Arabidopsis thaliana
actggagtttctgtgattatg

SEQ ID NO: 6421 - DNA, 23 bp, Arabidopsis thaliana
aattgattgttgatgatgattct

SEQ ID NO: 6422 - DNA, 19 bp, Arabidopsis thaliana
tatgatgcagattctccat

SEQ ID NO: 6423 - DNA, 23 bp, Arabidopsis thaliana
tctgtttggctttcttcatcttc

SEQ ID NO: 6424 - DNA, 20 bp, Arabidopsis thaliana
tgcagaggtatattgtagag

SEQ ID NO: 6425 - DNA, 21 bp, Arabidopsis thaliana
atttcagtttggtttcgttgt

SEQ ID NO: 6426 - DNA, 23 bp, Arabidopsis thaliana
catcttcttcttcttcatgctct

SEQ ID NO: 6427 - DNA, 20 bp, Arabidopsis thaliana
atggcatacgattagtgaga

SEQ ID NO: 6428 - DNA, 20 bp, Arabidopsis thaliana
aagcacgattccaaagctgt

SEQ ID NO: 6429 - DNA, 19 bp, Arabidopsis thaliana
catcaactttgttgttgta

SEQ ID NO: 6430 - DNA, 19 bp, Arabidopsis thaliana
tgttcttggacttgtccct

SEQ ID NO: 6431 - DNA, 20 bp, Arabidopsis thaliana
agagctttgtttttttaggt

SEQ ID NO: 6432 - DNA, 20 bp, Arabidopsis thaliana
actgcaaatgaaatgtcgaa

SEQ ID NO: 6433 - DNA, 19 bp, Arabidopsis thaliana
tcacattgctgcgagtgaa

SEQ ID NO: 6434 - DNA, 20 bp, Arabidopsis thaliana
agagattagagactgtgatg

SEQ ID NO: 6435 - DNA, 18 bp, Arabidopsis thaliana
atttgtgttgttgttctc

SEQ ID NO: 6436 - DNA, 20 bp, Arabidopsis thaliana
tgtggaatcatgaaatcgta

SEQ ID NO: 6437 - DNA, 20 bp, Arabidopsis thaliana
tgagtgtgtatggtgtgaga

SEQ ID NO: 6438 - DNA, 18 bp, Arabidopsis thaliana
acatgtgtgaggatttgt

SEQ ID NO: 6439 - DNA, 20 bp, Arabidopsis thaliana
ttggtgtgtagtacaatgta

SEQ ID NO: 6440 - DNA, 22 bp, Arabidopsis thaliana
tgtgttgttgaagaacaagaag

SEQ ID NO: 6441 - DNA, 18 bp, Arabidopsis thaliana
attatgttgatgatgctg

SEQ ID NO: 6442 - DNA, 22 bp, Arabidopsis thaliana
cgtgaaagactgcttctcgttc

SEQ ID NO: 6443 - DNA, 18 bp, Arabidopsis thaliana
tcatcgttatcatcgtga

SEQ ID NO: 6444 - DNA, 21 bp, Arabidopsis thaliana
atgagagatgatttggtggag

SEQ ID NO: 6445 - DNA, 19 bp, Arabidopsis thaliana
tttggatttcttcatcttt

SEQ ID NO: 6446 - DNA, 20 bp, Arabidopsis thaliana
aactcaggatggatagcgcc

SEQ ID NO: 6447 - DNA, 18 bp, Arabidopsis thaliana
gttgatttttcttcttct

SEQ ID NO: 6448 - DNA, 20 bp, Arabidopsis thaliana
attgtcagcttatgttggag

SEQ ID NO: 6449 - DNA, 18 bp, Arabidopsis thaliana
tgtgctatgtgtttctga

SEQ ID NO: 6450 - DNA, 20 bp, Arabidopsis thaliana
gtttggtctcaggagcttca

SEQ ID NO: 6451 - DNA, 21 bp, Arabidopsis thaliana
tctcatctcttgatcttcttg

SEQ ID NO: 6452 - DNA, 18 bp, Arabidopsis thaliana
atgcttcaagttagtagt

SEQ ID NO: 6453 - DNA, 18 bp, Arabidopsis thaliana
ctctgttctgttgaactg

SEQ ID NO: 6454 - DNA, 18 bp, Arabidopsis thaliana
atatttcttcttcttttg

SEQ ID NO: 6455 - DNA, 22 bp, Arabidopsis thaliana
gattgttgctgatgctgctgct

SEQ ID NO: 6456 - DNA, 18 bp, Arabidopsis thaliana
atgtctgtctgaatatgt

SEQ ID NO: 6457 - DNA, 20 bp, Arabidopsis thaliana
tgagactctgtaactatgtc

SEQ ID NO: 6458 - DNA, 19 bp, Arabidopsis thaliana
taatctcattttcaatttg

SEQ ID NO: 6459 - DNA, 22 bp, Arabidopsis thaliana
tcttggtcatgatcatcatcgt

SEQ ID NO: 6460 - DNA, 18 bp, Arabidopsis thaliana
gagctaacagtgaattgt

SEQ ID NO: 6461 - DNA, 23 bp, Arabidopsis thaliana
tcatgaagatgaagatgaagaag

SEQ ID NO: 6462 - DNA, 20 bp, Arabidopsis thaliana
tgtgagcattgctttgctgt

SEQ ID NO: 6463 - DNA, 20 bp, Arabidopsis thaliana
taggaggtgtaggtgctggt

SEQ ID NO: 6464 - DNA, 23 bp, Arabidopsis thaliana
taggaggtgtaggtgctggtgtg

SEQ ID NO: 6465 - DNA, 20 bp, Arabidopsis thaliana
taggaggtgtaggtgctggt

SEQ ID NO: 6466 - DNA, 23 bp, Arabidopsis thaliana
ttgtgtttcatattcttggatca

SEQ ID NO: 6467 - DNA, 19 bp, Arabidopsis thaliana
cagcggttgctgctgctga

SEQ ID NO: 6468 - DNA, 19 bp, Arabidopsis thaliana
tgtagattgatgtggaaga

SEQ ID NO: 6469 - DNA, 23 bp, Arabidopsis thaliana
tgtctagtgatgatgatgatgaa

SEQ ID NO: 6470 - DNA, 22 bp, Arabidopsis thaliana
tgactcctactcttggtgtgtt

SEQ ID NO: 6471 - DNA, 19 bp, Arabidopsis thaliana
tcactggccatcttcatct

SEQ ID NO: 6472 - DNA, 21 bp, Arabidopsis thaliana
ttgcttgatttttgatgtttc

SEQ ID NO: 6473 - DNA, 19 bp, Arabidopsis thaliana
taattggttgagctttgtg

SEQ ID NO: 6474 - DNA, 19 bp, Arabidopsis thaliana
tttcattgatggtgatgat

SEQ ID NO: 6475 - DNA, 18 bp, Arabidopsis thaliana
ttctcttgtgttgttatt

SEQ ID NO: 6476 - DNA, 20 bp, Arabidopsis thaliana
tacagtcacatccactttct

SEQ ID NO: 6477 - DNA, 23 bp, Arabidopsis thaliana
tgtctctgtctctgtcacagttt

SEQ ID NO: 6478 - DNA, 19 bp, Arabidopsis thaliana
tgatccaggtctgttgcag

SEQ ID NO: 6479 - DNA, 22 bp, Arabidopsis thaliana
tctccttctcctccaggacctc

SEQ ID NO: 6480 - DNA, 20 bp, Arabidopsis thaliana
tttgatcatgtttgtgtgtg

SEQ ID NO: 6481 - DNA, 23 bp, Arabidopsis thaliana
tctgtcttcatcatcttcgtcct

SEQ ID NO: 6482 - DNA, 18 bp, Arabidopsis thaliana
attgtagtgtatgtgttg

SEQ ID NO: 6483 - DNA, 20 bp, Arabidopsis thaliana
aagtgctgagatcaatgagg

SEQ ID NO: 6484 - DNA, 20 bp, Arabidopsis thaliana
atgtgggtggatgtgatgtg

SEQ ID NO: 6485 - DNA, 23 bp, Arabidopsis thaliana
ttggattctgatgttggtccact

SEQ ID NO: 6486 - DNA, 23 bp, Arabidopsis thaliana
tgagagagagagagagaggctct

SEQ ID NO: 6487 - DNA, 19 bp, Arabidopsis thaliana
cactgtcggcttcgaccac

SEQ ID NO: 6488 - DNA, 21 bp, Arabidopsis thaliana
taatttggtgtttcttcgatc

SEQ ID NO: 6489 - DNA, 23 bp, Arabidopsis thaliana
tgattgagccgtgtcaatatctc

SEQ ID NO: 6490 - DNA, 19 bp, Arabidopsis thaliana
ttgtttgtgttcttgagta

SEQ ID NO: 6491 - DNA, 18 bp, Arabidopsis thaliana
ctccatttgatttgctgc

SEQ ID NO: 6492 - DNA, 18 bp, Arabidopsis thaliana
ttttatgatgatgatcag

SEQ ID NO: 6493 - DNA, 18 bp, Arabidopsis thaliana
aagattgaagtgcttgaa

SEQ ID NO: 6494 - DNA, 21 bp, Arabidopsis thaliana
attgtacctgttgatgaggag

SEQ ID NO: 6495 - DNA, 23 bp, Arabidopsis thaliana
tcatcatcatcatcatcaatgtc

SEQ ID NO: 6496 - DNA, 20 bp, Arabidopsis thaliana
aagttctctcttcgacaaaa

SEQ ID NO: 6497 - DNA, 23 bp, Arabidopsis thaliana
atgagttgggtctaacccataac

SEQ ID NO: 6498 - DNA, 18 bp, Arabidopsis thaliana
gtagtagaagaagaagta

SEQ ID NO: 6499 - DNA, 18 bp, Arabidopsis thaliana
gtagtagaagaagaagta

SEQ ID NO: 6500 - DNA, 18 bp, Arabidopsis thaliana
ctttgtgcaaaaaccatc

SEQ ID NO: 6501 - DNA, 23 bp, Arabidopsis thaliana
aggtagatgaatgttgatggtgt

SEQ ID NO: 6502 - DNA, 18 bp, Arabidopsis thaliana
agtagtgatttgtatttg

SEQ ID NO: 6503 - DNA, 21 bp, Arabidopsis thaliana
tgaaatgtgatgatgatgatg

SEQ ID NO: 6504 - DNA, 18 bp, Arabidopsis thaliana
actgcatttctattgatg

SEQ ID NO: 6505 - DNA, 22 bp, Arabidopsis thaliana
tacttgaactacgagaagaagt

SEQ ID NO: 6506 - DNA, 20 bp, Arabidopsis thaliana
agacattgtagttgttggaa

SEQ ID NO: 6507 - DNA, 19 bp, Arabidopsis thaliana
tgagtggtgaagaaggtga

SEQ ID NO: 6508 - DNA, 19 bp, Arabidopsis thaliana
taacgtcgtcttcttcagc

SEQ ID NO: 6509 - DNA, 22 bp, Arabidopsis thaliana
ccacctccgccgccgccgctgc

SEQ ID NO: 6510 - DNA, 18 bp, Arabidopsis thaliana
tgagattggtagtgatga

SEQ ID NO: 6511 - DNA, 18 bp, Arabidopsis thaliana
ttttgttttgaagatgga

SEQ ID NO: 6512 - DNA, 18 bp, Arabidopsis thaliana
aagaagaagaagaagatg

SEQ ID NO: 6513 - DNA, 22 bp, Arabidopsis thaliana
tgcttcttcttcttcttcgacc

SEQ ID NO: 6514 - DNA, 23 bp, Arabidopsis thaliana
tcttcttcttcatcttcatcatc

SEQ ID NO: 6515 - DNA, 23 bp, Arabidopsis thaliana
tgaacatcatcatcatcataatc

SEQ ID NO: 6516 - DNA, 20 bp, Arabidopsis thaliana
tcagatctctttgttagctc

SEQ ID NO: 6517 - DNA, 21 bp, Arabidopsis thaliana
tatgtgttttgatttgtgaag

SEQ ID NO: 6518 - DNA, 19 bp, Arabidopsis thaliana
tgatcctgcatcagcaagt

SEQ ID NO: 6519 - DNA, 23 bp, Arabidopsis thaliana
ttttcgtcttcttcttcattgtt

SEQ ID NO: 6520 - DNA, 23 bp, Arabidopsis thaliana
caccttcatcttcatcttcatcg

SEQ ID NO: 6521 - DNA, 23 bp, Arabidopsis thaliana
agctcagattgttgatgttgttg

SEQ ID NO: 6522 - DNA, 20 bp, Arabidopsis thaliana
ttttgcttgagaaatcgctt

SEQ ID NO: 6523 - DNA, 20 bp, Arabidopsis thaliana
accatcatcgtcgtcgtcag

SEQ ID NO: 6524 - DNA, 19 bp, Arabidopsis thaliana
ggtggtgctgccgctgctg

SEQ ID NO: 6525 - DNA, 19 bp, Arabidopsis thaliana
aagcagcagcggcagttgc

SEQ ID NO: 6526 - DNA, 21 bp, Arabidopsis thaliana
tgcctggctccctgtatgcca

SEQ ID NO: 6527 - DNA, 18 bp, Arabidopsis thaliana
tgtctattttggatgatg

SEQ ID NO: 6528 - DNA, 23 bp, Arabidopsis thaliana
agtctgagtgtgtgtgattctgt

SEQ ID NO: 6529 - DNA, 20 bp, Arabidopsis thaliana
tttgttgttgttgctgctga

SEQ ID NO: 6530 - DNA, 21 bp, Arabidopsis thaliana
tacattgattttcttgcagct

SEQ ID NO: 6531 - DNA, 20 bp, Arabidopsis thaliana
atcttcttcttcttcgttgt

SEQ ID NO: 6532 - DNA, 20 bp, Arabidopsis thaliana
caaagcagctgaagatctga

SEQ ID NO: 6533 - DNA, 20 bp, Arabidopsis thaliana
agagatgttcctcaaggttc

SEQ ID NO: 6534 - DNA, 18 bp, Arabidopsis thaliana
gtctctctctcactctct

SEQ ID NO: 6535 - DNA, 20 bp, Arabidopsis thaliana
tcctcttcttgctcttcgtc

SEQ ID NO: 6536 - DNA, 21 bp, Arabidopsis thaliana
actggttttcttgatgttgga

SEQ ID NO: 6537 - DNA, 23 bp, Arabidopsis thaliana
tttgatgtacttggatctaattc

SEQ ID NO: 6538 - DNA, 19 bp, Arabidopsis thaliana
agagtgatgattttgttgt

SEQ ID NO: 6539 - DNA, 21 bp, Arabidopsis thaliana
tcgcttggtgcaggtcgggaa

SEQ ID NO: 6540 - DNA, 19 bp, Arabidopsis thaliana
actcgctgggattgttgtt

SEQ ID NO: 6541 - DNA, 23 bp, Arabidopsis thaliana
attgtgcgagtgtgtgggtgggt

SEQ ID NO: 6542 - DNA, 18 bp, Arabidopsis thaliana
ggagccggcgccggcgcc

SEQ ID NO: 6543 - DNA, 19 bp, Arabidopsis thaliana
tgacgaagaagaagaagca

SEQ ID NO: 6544 - DNA, 19 bp, Arabidopsis thaliana
ttcattgttgttgttgggg

SEQ ID NO: 6545 - DNA, 20 bp, Arabidopsis thaliana
tgtgagagattcatttgtca

SEQ ID NO: 6546 - DNA, 20 bp, Arabidopsis thaliana
agtgatctctttgtgttctc

SEQ ID NO: 6547 - DNA, 20 bp, Arabidopsis thaliana
ggtggtgatgatggtgacag

SEQ ID NO: 6548 - DNA, 19 bp, Arabidopsis thaliana
tatgtgtgtgtttgttgaa

SEQ ID NO: 6549 - DNA, 22 bp, Arabidopsis thaliana
agaatcatcatcatcgtcttgt

SEQ ID NO: 6550 - DNA, 23 bp, Arabidopsis thaliana
tgtatgtgtgtgtgagagttgat

SEQ ID NO: 6551 - DNA, 23 bp, Arabidopsis thaliana
atcgtcttcttcaacctcttcat

SEQ ID NO: 6552 - DNA, 22 bp, Arabidopsis thaliana
tttactgttgttgatgtaatgg

SEQ ID NO: 6553 - DNA, 19 bp, Arabidopsis thaliana
tcatagttgttcactctct

SEQ ID NO: 6554 - DNA, 19 bp, Arabidopsis thaliana
tatgtgtgtgcatatgtct

SEQ ID NO: 6555 - DNA, 20 bp, Arabidopsis thaliana
aagaacctctttgtttttgt

SEQ ID NO: 6556 - DNA, 21 bp, Arabidopsis thaliana
acatcatcatcatcatcgtta

SEQ ID NO: 6557 - DNA, 21 bp, Arabidopsis thaliana
gattgtgtgtgcgtgtgtaag

SEQ ID NO: 6558 - DNA, 20 bp, Arabidopsis thaliana
ttggcagagcaagaacagtc

SEQ ID NO: 6559 - DNA, 19 bp, Arabidopsis thaliana
tatgttgttgttgttcaga

SEQ ID NO: 6560 - DNA, 19 bp, Arabidopsis thaliana
atgagtgtatatatggatg

SEQ ID NO: 6561 - DNA, 18 bp, Arabidopsis thaliana
tctctgtgctttggattc

SEQ ID NO: 6562 - DNA, 21 bp, Arabidopsis thaliana
tatgtgatgttgttgatgatg

SEQ ID NO: 6563 - DNA, 18 bp, Arabidopsis thaliana
gacatcctggtggacatg

SEQ ID NO: 6564 - DNA, 20 bp, Arabidopsis thaliana
aaggaggttgctctttgtgt

SEQ ID NO: 6565 - DNA, 18 bp, Arabidopsis thaliana
aaagtgcttctcttgtgg

2. The method of claim 1, further comprising:
synthetically removing the one or more precursor sequences from a genome that naturally contains the one or more precursor sequences; and
introducing the one or more precursor sequences into an environment that does not naturally contain the one or more precursor sequences to produce the at least one nucleic acid molecule biochemically.

3. The method of claim 1, further comprising:
using the at least one biochemically produced nucleic acid to produce one or more interfering ribonucleic acid molecules that correspond to one or more mature microRNAs embedded in the one or more precursor sequences and that induce post-transcriptional repression of one or more target sequences, wherein using the at least one biochemically produced nucleic acid to produce one or more interfering ribonucleic acid molecules comprises encoding one or more interfering ribonucleic acid sequences with the at least one biochemically produced nucleic acid.

4. The method of claim 3, wherein the one or more target sequences are naturally occurring.

5. The method of claim 3, wherein the one or more target sequences are synthetically constructed.

* * * * *